United States Patent 12,508,308 (INFLUENZA mRNA VACCINES) - sequence listing, part 43

SEQ ID NO: 165124 - RNA, 1701 nt, Artificial Sequence
  derived and/or modified sequence opt4 from hemagglutinin__InfluenzaA__AIL93906
augaaggccauccugguggugcugcuguacaccuucgccaccgccaacgccgacacccugugcaucggcuaccacgccaacaacagcaccgacaccguggacaccgugcuggagaagaacgugaccgugacccacagcaucaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165125 - RNA, 1701 nt, Artificial Sequence
  derived and/or modified sequence opt4 from hemagglutinin__InfluenzaA__AIL93917
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagaccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagaugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165126 - RNA, 1701 nt, Artificial Sequence; identical to SEQ ID NO: 162560
  derived and/or modified sequence opt4 from hemagglutinin__InfluenzaA__AIL93929

SEQ ID NO: 165127 - RNA, 1701 nt, Artificial Sequence
  derived and/or modified sequence opt4 from hemagglutinin__InfluenzaA__AIL93940
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugagcccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165128 - RNA, 1701 nt, Artificial Sequence; identical to SEQ ID NO: 162514
  derived and/or modified sequence opt4 from hemagglutinin__InfluenzaA__AIL93951

SEQ ID NO: 165129 - RNA, 1701 nt, Artificial Sequence; identical to SEQ ID NO: 162514
  derived and/or modified sequence opt4 from hemagglutinin__InfluenzaA__AIL93963

SEQ ID NO: 165130 - RNA, 1701 nt, Artificial Sequence; identical to SEQ ID NO: 162378
  derived and/or modified sequence opt4 from hemagglutinin__InfluenzaA__AIL93975

SEQ ID NO: 165131 - RNA, 1701 nt, Artificial Sequence; identical to SEQ ID NO: 165107
  derived and/or modified sequence opt4 from hemagglutinin__InfluenzaA__AIL93987

SEQ ID NO: 165132 - RNA, 1701 nt, Artificial Sequence; identical to SEQ ID NO: 162514
  derived and/or modified sequence opt4 from hemagglutinin__InfluenzaA__AIL93998

SEQ ID NO: 165133 - RNA, 1701 nt, Artificial Sequence; identical to SEQ ID NO: 165104
  derived and/or modified sequence opt4 from hemagglutinin__InfluenzaA__AIL94010

SEQ ID NO: 165134 - RNA, 1701 nt, Artificial Sequence; identical to SEQ ID NO: 165104
  derived and/or modified sequence opt4 from hemagglutinin__InfluenzaA__AIL94022

SEQ ID NO: 165135 - RNA, 1701 nt, Artificial Sequence
  derived and/or modified sequence opt4 from hemagglutinin__InfluenzaA__AIL94046
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagaccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165136 - RNA, 1701 nt, Artificial Sequence
  derived and/or modified sequence opt4 from hemagglutinin__InfluenzaA__AIL94058
augaaggccauccugguggugcugcuguacaccuucgcccccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccaucgagagaagcgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165137 - RNA, 1701 nt, Artificial Sequence; identical to SEQ ID NO: 165107
  derived and/or modified sequence opt4 from hemagglutinin__InfluenzaA__AIL94069

SEQ ID NO: 165138 - RNA, 1701 nt, Artificial Sequence; identical to SEQ ID NO: 162560
  derived and/or modified sequence opt4 from hemagglutinin__InfluenzaA__AIL94080

SEQ ID NO: 165139 - RNA, 1701 nt, Artificial Sequence; identical to SEQ ID NO: 165104
  derived and/or modified sequence opt4 from hemagglutinin__InfluenzaA__AIL94235

SEQ ID NO: 165140 - RNA, 1701 nt, Artificial Sequence; identical to SEQ ID NO: 162560
  derived and/or modified sequence opt4 from hemagglutinin__InfluenzaA__AIL94247

SEQ ID NO: 165141 - RNA, 1701 nt, Artificial Sequence
  derived and/or modified sequence opt4 from hemagglutinin__InfluenzaA__AIL94258
augaagaccaucaucgcccugagcuacauccugugccugguguucacccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165142 - RNA, 1701 nt, Artificial Sequence
  derived and/or modified sequence opt4 from hemagglutinin__InfluenzaA__AIL94270
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165143 - RNA, 1701 nt, Artificial Sequence; identical to SEQ ID NO: 162514
  derived and/or modified sequence opt4 from hemagglutinin__InfluenzaA__AIL94282

SEQ ID NO: 165144 - RNA, 1701 nt, Artificial Sequence; identical to SEQ ID NO: 162514
  derived and/or modified sequence opt4 from hemagglutinin__InfluenzaA__AIL94294

SEQ ID NO: 165145 - RNA, 1701 nt, Artificial Sequence
  derived and/or modified sequence opt4 from hemagglutinin__InfluenzaA__AIL94306
augaagaccaucaccgcccugagcuacauccugugccuggccuucgcccagaagccccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165146 - RNA, 1701 nt, Artificial Sequence
  derived and/or modified sequence opt4 from hemagglutinin__InfluenzaA__AIL94318
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccugaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165147 - RNA, 1701 nt, Artificial Sequence; identical to SEQ ID NO: 162378
  derived and/or modified sequence opt4 from hemagglutinin__InfluenzaA__AIL94330

SEQ ID NO: 165148 - RNA, 1701 nt, Artificial Sequence; identical to SEQ ID NO: 162560
  derived and/or modified sequence opt4 from hemagglutinin__InfluenzaA__AIL94354

SEQ ID NO: 165149 - RNA, 1701 nt, Artificial Sequence; identical to SEQ ID NO: 162514
  derived and/or modified sequence opt4 from hemagglutinin__InfluenzaA__AIL94365

SEQ ID NO: 165150 - RNA, 1701 nt, Artificial Sequence
  derived and/or modified sequence opt4 from hemagglutinin__InfluenzaA__AIL94377
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccacugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165151 - RNA, 1701 nt, Artificial Sequence
  derived and/or modified sequence opt4 from hemagglutinin__InfluenzaA__AIL94389
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugauccugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165152 - RNA, 1701 nt, Artificial Sequence; identical to SEQ ID NO: 162514
  derived and/or modified sequence opt4 from hemagglutinin__InfluenzaA__AIL94411

SEQ ID NO: 165153 - RNA, 1701 nt, Artificial Sequence; identical to SEQ ID NO: 162514
  derived and/or modified sequence opt4 from hemagglutinin__InfluenzaA__AIL94423

SEQ ID NO: 165154 - RNA, 1701 nt, Artificial Sequence; identical to SEQ ID NO: 165107
  derived and/or modified sequence opt4 from hemagglutinin__InfluenzaA__AIL94435

SEQ ID NO: 165155 - RNA, 1701 nt, Artificial Sequence; identical to SEQ ID NO: 162514
  derived and/or modified sequence opt4 from hemagglutinin__InfluenzaA__AIL94446

SEQ ID NO: 165156 - RNA, 1701 nt, Artificial Sequence; identical to SEQ ID NO: 162514
  derived and/or modified sequence opt4 from hemagglutinin__InfluenzaA__AIL94458

SEQ ID NO: 165157 - RNA, 1701 nt, Artificial Sequence
  derived and/or modified sequence opt4 from hemagglutinin__InfluenzaA__AIL94470
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgcccacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165158 - RNA, 1701 nt, Artificial Sequence
  derived and/or modified sequence opt4 from hemagglutinin__InfluenzaA__AIL94481
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggaucaucuggaucagcuucgccaucagcugcuuccugcugugcguggcccugcugggcuucaucaugugggccugccagaagggcaacaucagaugcaacaucugcaucuga

SEQ ID NO: 165159 - RNA, 1701 nt, Artificial Sequence
  derived and/or modified sequence opt4 from hemagglutinin__InfluenzaA__AIL94493
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagaagaacgccggcagcggcaucaucaucagcgacacccccgugcacgacugcaacaccaccugccagacccccgagggcgccaucaacaccagcuuccccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165160 - RNA, 1701 nt, Artificial Sequence; identical to SEQ ID NO: 165107
  derived and/or modified sequence opt4 from hemagglutinin__InfluenzaA__AIL94504

SEQ ID NO: 165161 - RNA, 1701 nt, Artificial Sequence; identical to SEQ ID NO: 162514
  derived and/or modified sequence opt4 from hemagglutinin__InfluenzaA__AIL94515

SEQ ID NO: 165162 - RNA, 1701 nt, Artificial Sequence; identical to SEQ ID NO: 162514
  derived and/or modified sequence opt4 from hemagglutinin__InfluenzaA__AIL94527

SEQ ID NO: 165163 - RNA, 1701 nt, Artificial Sequence
  derived and/or modified sequence opt4 from hemagglutinin__InfluenzaA__AIL94539
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgcccacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165164 - RNA, 1701 nt, Artificial Sequence; identical to SEQ ID NO: 165107
  derived and/or modified sequence opt4 from hemagglutinin__InfluenzaA__AIL94550

SEQ ID NO: 165165 - RNA, 1701 nt, Artificial Sequence
  derived and/or modified sequence opt4 from hemagglutinin__InfluenzaA__AIL94561
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagagaggcaacaucagaugcaacaucugcaucuga

SEQ ID NO: 165166 - RNA, 1701 nt, Artificial Sequence
  derived and/or modified sequence opt4 from hemagglutinin__InfluenzaA__AIL94573
augaaggccauccugguggugcugcuguacaccuucgccaccgccaacgccgacacccugugcaucggcuaccacgccaacaacagcaccgacaccguggacaccgugcuggagaagaacgugaucgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaguguaccagauccuggccaucuacagcaccguggccagcagccuggugcugguggugagccugggcgccaucagcuucuggaugugcagcaacggcagccugcagugcagaaucugcaucuga

SEQ ID NO: 165167 - RNA, 1701 nt, Artificial Sequence
  derived and/or modified sequence opt4 from hemagglutinin__InfluenzaA__AIL94584
augaaggccauccugguggugcugcuguacaccuucgccaccgccaacgccgacacccugugcaucggcuaccacgccaacaacagcaccgacaccguggacaccgugcuggagaagaacaucaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcagaugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165168 - RNA, 1701 nt, Artificial Sequence; identical to SEQ ID NO: 164575
  derived and/or modified sequence opt4 from hemagglutinin__InfluenzaA__AIL94595

SEQ ID NO: 165169 - RNA, 1701 nt, Artificial Sequence; identical to SEQ ID NO: 162514
  derived and/or modified sequence opt4 from hemagglutinin__InfluenzaA__AIL94606

SEQ ID NO: 165170 - RNA, 1701 nt, Artificial Sequence; identical to SEQ ID NO: 162560
  derived and/or modified sequence opt4 from hemagglutinin__InfluenzaA__AIL94618

SEQ ID NO: 165171 - RNA, 1701 nt, Artificial Sequence; identical to SEQ ID NO: 165107
  derived and/or modified sequence opt4 from hemagglutinin__InfluenzaA__AIL94629

SEQ ID NO: 165172 - RNA, 1701 nt, Artificial Sequence; identical to SEQ ID NO: 162514
  derived and/or modified sequence opt4 from hemagglutinin__InfluenzaA__AIL94640

SEQ ID NO: 165173 - RNA, 1701 nt, Artificial Sequence
  derived and/or modified sequence opt4 from hemagglutinin__InfluenzaA__AIL94652
augaaggccauccugguggugcugcuguacaccuucgccaccgccaacgccgacacccugugcaucggcuaccacgccaacaacagcaccgacaccguggacaccgugcuggagaagaacgugaccgugacccacagcaucaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcuggacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165174 - RNA, 1701 nt, Artificial Sequence; identical to SEQ ID NO: 162560
  derived and/or modified sequence opt4 from hemagglutinin__InfluenzaA__AIL94663

SEQ ID NO: 165175 - RNA, 1701 nt, Artificial Sequence; identical to SEQ ID NO: 162560
  derived and/or modified sequence opt4 from hemagglutinin__InfluenzaA__AIL94674

SEQ ID NO: 165176 - RNA, 1701 nt, Artificial Sequence; identical to SEQ ID NO: 162514
  derived and/or modified sequence opt4 from hemagglutinin__InfluenzaA__AIL94697

SEQ ID NO: 165177 - RNA, 1701 nt, Artificial Sequence; identical to SEQ ID NO: 162560
  derived and/or modified sequence opt4 from hemagglutinin__InfluenzaA__AIL94709

SEQ ID NO: 165178 - RNA, 1701 nt, Artificial Sequence; identical to SEQ ID NO: 162560
  derived and/or modified sequence opt4 from hemagglutinin__InfluenzaA__AIL94720

SEQ ID NO: 165179 - RNA, 1701 nt, Artificial Sequence; identical to SEQ ID NO: 162514
  derived and/or modified sequence opt4 from hemagglutinin__InfluenzaA__AIL94731

SEQ ID NO: 165180 - RNA, 1701 nt, Artificial Sequence; identical to SEQ ID NO: 165107
  derived and/or modified sequence opt4 from hemagglutinin__InfluenzaA__AIL94743

SEQ ID NO: 165181 - RNA, 1701 nt, Artificial Sequence
  derived and/or modified sequence opt4 from hemagglutinin__InfluenzaA__AIL94754
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugauccugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgccaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165182 - RNA, 1701 nt, Artificial Sequence; identical to SEQ ID NO: 165135
  derived and/or modified sequence opt4 from hemagglutinin__InfluenzaA__AIL94765

SEQ ID NO: 165183 - RNA, 1701 nt, Artificial Sequence; identical to SEQ ID NO: 162514
  derived and/or modified sequence opt4 from hemagglutinin__InfluenzaA__AIL94777

SEQ ID NO: 165184 - RNA, 1701 nt, Artificial Sequence; identical to SEQ ID NO: 164422
  derived and/or modified sequence opt4 from hemagglutinin__InfluenzaA__AIL94789

SEQ ID NO: 165185 - RNA, 1701 nt, Artificial Sequence; identical to SEQ ID NO: 162560
  derived and/or modified sequence opt4 from hemagglutinin__InfluenzaA__AIL94800

SEQ ID NO: 165186 - RNA, 1701 nt, Artificial Sequence
  derived and/or modified sequence opt4 from hemagglutinin__InfluenzaA__AIL94811
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165187 - RNA, 1701 nt, Artificial Sequence; identical to SEQ ID NO: 162378
  derived and/or modified sequence opt4 from hemagglutinin__InfluenzaA__AIL94823

SEQ ID NO: 165188 - RNA, 1701 nt, Artificial Sequence
  derived and/or modified sequence opt4 from hemagglutinin__InfluenzaA__AIL94835
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacuacagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165189 - RNA, 1701 nt, Artificial Sequence
  derived and/or modified sequence opt4 from hemagglutinin__InfluenzaA__AIL94847
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacgacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165190 - RNA, 1701 nt, Artificial Sequence; identical to SEQ ID NO: 158053
  derived and/or modified sequence opt4 from hemagglutinin__InfluenzaA__AIL94859

SEQ ID NO: 165191 - RNA, 1701 nt, Artificial Sequence
  derived and/or modified sequence opt4 from hemagglutinin__InfluenzaA__AIL94871
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaccaucuaccacaagugcgacaacgccugcaucggcagcaucagaaacggcaccuacgaccacaacguguacagagacgaggcccugaacaacagauuccagaucaagggcaucgagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165192 - RNA, 1701 nt, Artificial Sequence; identical to SEQ ID NO: 164600
  derived and/or modified sequence opt4 from hemagglutinin__InfluenzaA__AIL94883

SEQ ID NO: 165193 - RNA, 1701 nt, Artificial Sequence; identical to SEQ ID NO: 164585
  derived and/or modified sequence opt4 from hemagglutinin__InfluenzaA__AIL94894

SEQ ID NO: 165194 - RNA, 1701 nt, Artificial Sequence; identical to SEQ ID NO: 162378
  derived and/or modified sequence opt4 from hemagglutinin__InfluenzaA__AIL94906

SEQ ID NO: 165195 - RNA, 1701 nt, Artificial Sequence; identical to SEQ ID NO: 162514
  derived and/or modified sequence opt4 from hemagglutinin__InfluenzaA__AIL94918

SEQ ID NO: 165196 - RNA, 1701 nt, Artificial Sequence; identical to SEQ ID NO: 162514
  derived and/or modified sequence opt4 from hemagglutinin__InfluenzaA__AIL94930

SEQ ID NO: 165197 - RNA, 1701 nt, Artificial Sequence; identical to SEQ ID NO: 162514
  derived and/or modified sequence opt4 from hemagglutinin__InfluenzaA__AIL94942

SEQ ID NO: 165198 - RNA, 1701 nt, Artificial Sequence; identical to SEQ ID NO: 162560
  derived and/or modified sequence opt4 from hemagglutinin__InfluenzaA__AIL94954

SEQ ID NO: 165199 - RNA, 1701 nt, Artificial Sequence; identical to SEQ ID NO: 162378
  derived and/or modified sequence opt4 from hemagglutinin__InfluenzaA__AIL94965

SEQ ID NO: 165200 - RNA, 1701 nt, Artificial Sequence
  derived and/or modified sequence opt4 from hemagglutinin__InfluenzaA__AIM55837
augaaggccauccugguggugcugcuguacaccuucgccaccgccaccgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagccuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165201 - RNA, 1701 nt, Artificial Sequence
  derived and/or modified sequence opt4 from hemagglutinin__InfluenzaA__AIM55848
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacaccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165202 - RNA, 1701 nt, Artificial Sequence; identical to SEQ ID NO: 162560
  derived and/or modified sequence opt4 from hemagglutinin__InfluenzaA__AIM55859

SEQ ID NO: 165203 - RNA, 1701 nt, Artificial Sequence; identical to SEQ ID NO: 162560
  derived and/or modified sequence opt4 from hemagglutinin__InfluenzaA__AIM55870

SEQ ID NO: 165204 - RNA, 1701 nt, Artificial Sequence; identical to SEQ ID NO: 162560
  derived and/or modified sequence opt4 from hemagglutinin__InfluenzaA__AIM55881

SEQ ID NO: 165205 - RNA, 1701 nt, Artificial Sequence; identical to SEQ ID NO: 164422
  derived and/or modified sequence opt4 from hemagglutinin__InfluenzaA__AIM55893

SEQ ID NO: 165206 - RNA, 1701 nt, Artificial Sequence; identical to SEQ ID NO: 163541
  derived and/or modified sequence opt4 from hemagglutinin__InfluenzaA__AIM55904

SEQ ID NO: 165207 - RNA, 1701 nt, Artificial Sequence; identical to SEQ ID NO: 162560
  derived and/or modified sequence opt4 from hemagglutinin__InfluenzaA__AIM55915

SEQ ID NO: 165208 - RNA, 1710 nt, Artificial Sequence
  derived and/or modified sequence opt4 from hemagglutinin__InfluenzaA__AIM55926
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165209 - RNA, 1701 nt, Artificial Sequence; identical to SEQ ID NO: 162560
  derived and/or modified sequence opt4 from hemagglutinin__InfluenzaA__AIM55937

SEQ ID NO: 165210 - RNA, 1701 nt, Artificial Sequence; identical to SEQ ID NO: 163541
  derived and/or modified sequence opt4 from hemagglutinin__InfluenzaA__AIM55948

SEQ ID NO: 165211 - RNA, 1701 nt, Artificial Sequence; identical to SEQ ID NO: 163523
  derived and/or modified sequence opt4 from hemagglutinin__InfluenzaA__AIM55962

SEQ ID NO: 165212 - RNA, 1701 nt, Artificial Sequence; identical to SEQ ID NO: 163541
  derived and/or modified sequence opt4 from hemagglutinin__InfluenzaA__AIM55984

SEQ ID NO: 165213 - RNA, 1701 nt, Artificial Sequence; identical to SEQ ID NO: 164422
  derived and/or modified sequence opt4 from hemagglutinin__InfluenzaA__AIM55995

SEQ ID NO: 165214 - RNA, 1701 nt, Artificial Sequence
  derived and/or modified sequence opt4 from hemagglutinin__InfluenzaA__AIM56017
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggccacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165215 - RNA, 1701 nt, Artificial Sequence; identical to SEQ ID NO: 165214
  derived and/or modified sequence opt4 from hemagglutinin__InfluenzaA__AIM56028

SEQ ID NO: 165216 - RNA, 1701 nt, Artificial Sequence
  derived and/or modified sequence opt4 from hemagglutinin__InfluenzaA__AIM56039
augaaggccauccugguggugcugcuguaccccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggaggccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165217 - RNA, 1701 nt, Artificial Sequence
  derived and/or modified sequence opt4 from hemagglutinin__InfluenzaA__AIM56050
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagaggcaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165218 - RNA, 1701 nt, Artificial Sequence; identical to SEQ ID NO: 162560
  derived and/or modified sequence opt4 from hemagglutinin__InfluenzaA__AIM56061

SEQ ID NO: 165219 - RNA, 1701 nt, Artificial Sequence; identical to SEQ ID NO: 162560
  derived and/or modified sequence opt4 from hemagglutinin__InfluenzaA__AIM56072

SEQ ID NO: 165220 - RNA, 1701 nt, Artificial Sequence; identical to SEQ ID NO: 164413
  derived and/or modified sequence opt4 from hemagglutinin__InfluenzaA__AIM56083

SEQ ID NO: 165221 - RNA, 1701 nt, Artificial Sequence; identical to SEQ ID NO: 162560
  derived and/or modified sequence opt4 from hemagglutinin__InfluenzaA__AIM56105

SEQ ID NO: 165222 - RNA, 1701 nt, Artificial Sequence; identical to SEQ ID NO: 162560
  derived and/or modified sequence opt4 from hemagglutinin__InfluenzaA__AIM56116

SEQ ID NO: 165223 - RNA, 1701 nt, Artificial Sequence
  derived and/or modified sequence opt4 from hemagglutinin__InfluenzaA__AIM56127
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaaggccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165224 - RNA, 1701 nt, Artificial Sequence; identical to SEQ ID NO: 162560
  derived and/or modified sequence opt4 from hemagglutinin__InfluenzaA__AIM56138

SEQ ID NO: 165225 - RNA, 1701 nt, Artificial Sequence; identical to SEQ ID NO: 162560
  derived and/or modified sequence opt4 from hemagglutinin__InfluenzaA__AIM56149

SEQ ID NO: 165226 - RNA, 1701 nt, Artificial Sequence; identical to SEQ ID NO: 164413
  derived and/or modified sequence opt4 from hemagglutinin__InfluenzaA__AIM56160

SEQ ID NO: 165227 - RNA, 1701 nt, Artificial Sequence; identical to SEQ ID NO: 162560
  derived and/or modified sequence opt4 from hemagglutinin__InfluenzaA__AIM56171

SEQ ID NO: 165228 - RNA, 1701 nt, Artificial Sequence
  derived and/or modified sequence opt4 from hemagglutinin__InfluenzaA__AIM56182
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaaggccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacaaggagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165229 - RNA, 1701 nt, Artificial Sequence
  derived and/or modified sequence opt4 from hemagglutinin__InfluenzaA__AIM56193
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaaggugaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165230 - RNA, 1701 nt, Artificial Sequence; identical to SEQ ID NO: 162560
  derived and/or modified sequence opt4 from hemagglutinin__InfluenzaA__AIM56204

SEQ ID NO: 165231 - RNA, 1701 nt, Artificial Sequence; identical to SEQ ID NO: 162560
  derived and/or modified sequence opt4 from hemagglutinin__InfluenzaA__AIM56215

SEQ ID NO: 165232 - RNA, 1701 nt, Artificial Sequence; identical to SEQ ID NO: 162560
  derived and/or modified sequence opt4 from hemagglutinin__InfluenzaA__AIM56226

SEQ ID NO: 165233 - RNA, 1701 nt, Artificial Sequence; identical to SEQ ID NO: 164971
  derived and/or modified sequence opt4 from hemagglutinin__InfluenzaA__AIM56237

SEQ ID NO: 165234 - RNA, 1701 nt, Artificial Sequence; identical to SEQ ID NO: 162560
  derived and/or modified sequence opt4 from hemagglutinin__InfluenzaA__AIM56259

SEQ ID NO: 165235 - RNA, 1701 nt, Artificial Sequence
  derived and/or modified sequence opt4 from hemagglutinin__InfluenzaA__AIM56270
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccgugaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165236 - RNA, 1701 nt, Artificial Sequence; identical to SEQ ID NO: 162560
  derived and/or modified sequence opt4 from hemagglutinin__InfluenzaA__AIM56281

SEQ ID NO: 165237 - RNA, 1701 nt, Artificial Sequence
  derived and/or modified sequence opt4 from hemagglutinin__InfluenzaA__AIM56292
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggagauccuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165238 - RNA, 1701 nt, Artificial Sequence
  derived and/or modified sequence opt4 from hemagglutinin__InfluenzaA__AIM56303
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccaggugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165239 - RNA, 1701 nt, Artificial Sequence
  derived and/or modified sequence opt4 from hemagglutinin__InfluenzaA__AIM56314
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165240 - RNA, 1701 nt, Artificial Sequence; identical to SEQ ID NO: 162560
  derived and/or modified sequence opt4 from hemagglutinin__InfluenzaA__AIM56325

SEQ ID NO: 165241 - RNA, 1701 nt, Artificial Sequence
  derived and/or modified sequence opt4 from hemagglutinin__InfluenzaA__AIM56336
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaagaucagaaaccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165242 - RNA, 1701 nt, Artificial Sequence
  derived and/or modified sequence opt4 from hemagglutinin__InfluenzaA__AIM56347
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccaccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165243 - RNA, 1701 nt, Artificial Sequence
  derived and/or modified sequence opt4 from hemagglutinin__InfluenzaA__AIM56358
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccuggugaagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165244 - RNA, 1701 nt, Artificial Sequence; identical to SEQ ID NO: 162560
  derived and/or modified sequence opt4 from hemagglutinin__InfluenzaA__AIM56369

SEQ ID NO: 165245 - RNA, 1701 nt, Artificial Sequence
  derived and/or modified sequence opt4 from hemagglutinin__InfluenzaA__AIM56380
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugagcagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165246 - RNA, 1701 nt, Artificial Sequence; identical to SEQ ID NO: 162560
  derived and/or modified sequence opt4 from hemagglutinin__InfluenzaA__AIM56391

SEQ ID NO: 165247 - RNA, 1701 nt, Artificial Sequence; identical to SEQ ID NO: 162560
  derived and/or modified sequence opt4 from hemagglutinin__InfluenzaA__AIM56402

SEQ ID NO: 165248 - RNA, 1701 nt, Artificial Sequence; identical to SEQ ID NO: 164413
  derived and/or modified sequence opt4 from hemagglutinin__InfluenzaA__AIM56413

SEQ ID NO: 165249 - RNA, 1701 nt, Artificial Sequence; identical to SEQ ID NO: 162560
  derived and/or modified sequence opt4 from hemagglutinin__InfluenzaA__AIM56425

SEQ ID NO: 165250 - RNA, 1701 nt, Artificial Sequence; identical to SEQ ID NO: 162560
  derived and/or modified sequence opt4 from hemagglutinin__InfluenzaA__AIM56436

SEQ ID NO: 165251 - RNA, 1701 nt, Artificial Sequence; identical to SEQ ID NO: 162560
  derived and/or modified sequence opt4 from hemagglutinin__InfluenzaA__AIM56447

SEQ ID NO: 165252 - RNA, 1701 nt, Artificial Sequence; identical to SEQ ID NO: 162560
  derived and/or modified sequence opt4 from hemagglutinin__InfluenzaA__AIM56469

SEQ ID NO: 165253 - RNA, 1701 nt, Artificial Sequence
  derived and/or modified sequence opt4 from hemagglutinin__InfluenzaA__AIM56480
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucacccugggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165254 - RNA, 1701 nt, Artificial Sequence; identical to SEQ ID NO: 162560
  derived and/or modified sequence opt4 from hemagglutinin__InfluenzaA__AIM56491

SEQ ID NO: 165255 - RNA, 1710 nt, Artificial Sequence
  derived and/or modified sequence opt4 from hemagglutinin__InfluenzaA__AIM56502
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaaggccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165256 - RNA, 1701 nt, Artificial Sequence; identical to SEQ ID NO: 162560
  derived and/or modified sequence opt4 from hemagglutinin__InfluenzaA__AIM56513

SEQ ID NO: 165257 - RNA, 1701 nt, Artificial Sequence; identical to SEQ ID NO: 164505
  derived and/or modified sequence opt4 from hemagglutinin__InfluenzaA__AIM56524

SEQ ID NO: 165258 - RNA, 1701 nt, Artificial Sequence; identical to SEQ ID NO: 162560
  derived and/or modified sequence opt4 from hemagglutinin__InfluenzaA__AIM56535

SEQ ID NO: 165259 - RNA, 1701 nt, Artificial Sequence; identical to SEQ ID NO: 162560
  derived and/or modified sequence opt4 from hemagglutinin__InfluenzaA__AIM56546

SEQ ID NO: 165260 - RNA, 1701 nt, Artificial Sequence; identical to SEQ ID NO: 164413
  derived and/or modified sequence opt4 from hemagglutinin__InfluenzaA__AIM56557

SEQ ID NO: 165261 - RNA, 1701 nt, Artificial Sequence
  derived and/or modified sequence opt4 from hemagglutinin__InfluenzaA__AIM56568
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuucagcaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165262 - RNA, 1701 nt, Artificial Sequence
  derived and/or modified sequence opt4 from hemagglutinin__InfluenzaA__AIM56579
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacgagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacaccgacgccuacguguucgugggcaccagcagauacagcaagaaguucaagcccgagaucgccaucagacccaaggugagagaccaggagggcagaaugagcuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165263 - RNA, 1710 nt, Artificial Sequence
  derived and/or modified sequence opt4 from hemagglutinin__InfluenzaA__AIM56590
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacgacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165264 - RNA, 1710 nt, Artificial Sequence
  derived and/or modified sequence opt4 from hemagglutinin__InfluenzaA__AIM56601
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165265 - RNA, 1710 nt, Artificial Sequence
  derived and/or modified sequence opt4 from hemagglutinin__InfluenzaA__AIM56612
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacaccggcagcggcaucaucaucagcgacacccccgugcacgacugcaacaccaccugccagacccccgagggcgccaucaacaccagccugaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165266 - RNA, 1701 nt, Artificial Sequence
  derived and/or modified sequence opt4 from hemagglutinin__InfluenzaA__AIM56623
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaccuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165267 - RNA, 1701 nt, Artificial Sequence
  derived and/or modified sequence opt4 from hemagglutinin__InfluenzaA__AIM56634
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaacagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165268 - RNA, 1710 nt, Artificial Sequence
  derived and/or modified sequence opt4 from hemagglutinin__InfluenzaA__AIM56645
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165269 - RNA, 1701 nt, Artificial Sequence
  derived and/or modified sequence opt4 from hemagglutinin__InfluenzaA__AIM56656
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaacaucguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165270 - RNA, 1701 nt, Artificial Sequence; identical to SEQ ID NO: 162560
  derived and/or modified sequence opt4 from hemagglutinin__InfluenzaA__AIM56667

SEQ ID NO: 165271 - RNA, 1701 nt, Artificial Sequence
  derived and/or modified sequence opt4 from hemagglutinin__InfluenzaA__AIM56678
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugcccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165272 - RNA, 1701 nt, Artificial Sequence; identical to SEQ ID NO: 164908
  derived and/or modified sequence opt4 from hemagglutinin__InfluenzaA__AIM56689

SEQ ID NO: 165273 - RNA, 1701 nt, Artificial Sequence; identical to SEQ ID NO: 162560
  derived and/or modified sequence opt4 from hemagglutinin__InfluenzaA__AIM56700

SEQ ID NO: 165274 - RNA, 1710 nt, Artificial Sequence
  derived and/or modified sequence opt4 from hemagglutinin__InfluenzaA__AIM56711
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugcccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165275 - RNA, 1701 nt, Artificial Sequence; identical to SEQ ID NO: 164908
  derived and/or modified sequence opt4 from hemagglutinin__InfluenzaA__AIM56722

SEQ ID NO: 165276 - RNA, 1701 nt, Artificial Sequence; identical to SEQ ID NO: 162560
  derived and/or modified sequence opt4 from hemagglutinin__InfluenzaA__AIM56733

SEQ ID NO: 165277 - RNA, 1701 nt, Artificial Sequence; identical to SEQ ID NO: 162560
  derived and/or modified sequence opt4 from hemagglutinin__InfluenzaA__AIM56744

SEQ ID NO: 165278 - RNA, 1701 nt, Artificial Sequence
  derived and/or modified sequence opt4 from hemagglutinin__InfluenzaA__AIM56755
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccagccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165279 - RNA, 1710 nt, Artificial Sequence; identical to SEQ ID NO: 165264
  derived and/or modified sequence opt4 from hemagglutinin__InfluenzaA__AIM56766

SEQ ID NO: 165280 - RNA, 1701 nt, Artificial Sequence
  derived and/or modified sequence opt4 from hemagglutinin__InfluenzaA__AIM56777
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggagggcaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuaccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165281 - RNA, 1701 nt, Artificial Sequence; identical to SEQ ID NO: 162560
  derived and/or modified sequence opt4 from hemagglutinin__InfluenzaA__AIM56788

SEQ ID NO: 165282 - RNA, 1701 nt, Artificial Sequence; identical to SEQ ID NO: 162560
  derived and/or modified sequence opt4 from hemagglutinin__InfluenzaA__AIM56799

SEQ ID NO: 165283 - RNA, 1701 nt, Artificial Sequence; identical to SEQ ID NO: 162560
  derived and/or modified sequence opt4 from hemagglutinin__InfluenzaA__AIM56810

SEQ ID NO: 165284 - RNA, 1701 nt, Artificial Sequence; identical to SEQ ID NO: 162560
  derived and/or modified sequence opt4 from hemagglutinin__InfluenzaA__AIM56821

SEQ ID NO: 165285 - RNA, 1683 nt, Artificial Sequence
  derived and/or modified sequence opt4 from hemagglutinin__InfluenzaA__AIN76383
augaacacccagauccugguguucgcccugaucgccaucgugcccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagaagaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggaggccaugggcuucaccuacagcggcaucagaaccaacggcaccaccagcgccugcagaagaagcggcagcagcuucuacgccgagaugaaguggcugcugagcaacaccgacaacgccgccuucccccagaugaccaagagcuacaagaacaccagaaagagccccgcccugaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugaugcugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagaagagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaacgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 165286 - RNA, 1689 nt, Artificial Sequence
  derived and/or modified sequence opt4 from hemagglutinin__InfluenzaA__AIP93103
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcacuucgagaaggugaagauccugcccaaggacggcuggacccagcacgagaccgacggcggcagcaaggccugcgccgugagcggcaagcccagcuucuucagaaacaugguguggcugaccaagaagggccccaacuaccccguggccaagagaagcuacaacaacaccagcggcgagcagaugcugaucaucuggggcgugcaccaccccaacgacgaggccgagcagagagcccuguaccagaacgugggcaccuacgugagcgccagcaccagcacccugaacaagagaagcacccccgagaucgccgccagacccaaggugagcggccugggcagcagaauggaguucagcuggacccugcuggacgugugggacaccaucagcuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccccagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacagaaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugaucgccggcaucagcuucuggaugugcagcaacggcagccugcagugcagaaucugcaucuga

SEQ ID NO: 165287 - RNA, 1689 nt, Artificial Sequence; identical to SEQ ID NO: 154175
  derived and/or modified sequence opt4 from hemagglutinin__InfluenzaA__AIP93115

SEQ ID NO: 165288 - RNA, 1701 nt, Artificial Sequence
  derived and/or modified sequence opt4 from hemagglutinin__InfluenzaA__AIR93971
augaaggccauccugguggugcugcuguacaccuucgccaccaccaacgccgacauccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccagaagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaccagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165289 - RNA, 1701 nt, Artificial Sequence
  derived and/or modified sequence opt4 from hemagglutinin__InfluenzaA__AIR93982
augaaggccauccugguggugcugcuguacaccaucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccagaagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaccaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165290 - RNA, 1701 nt, Artificial Sequence
  derived and/or modified sequence opt4 from hemagglutinin__InfluenzaA__AIR93993
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugaagggcguggccccccugcaccugggcaagugcaacaucgccggcuggauccugggcaaccccgagugcggcagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccccaacgccggcagcaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaauggacuacuacuggacccugguggagcccggcgacaagaucaccuucgaggccaccggcaaccugguggugcccagauacgccuucgccauggagagaaacaccggcagcggcaucaucaucagcgacacccccgugcacgacugcaacaccaucugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaagggcugcuucgaguucuaccacaagugcgacaccaugugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165291 - RNA, 1701 nt, Artificial Sequence
  derived and/or modified sequence opt4 from hemagglutinin__InfluenzaA__AIR94000
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagcuuccccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaccaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165292 - RNA, 1683 nt, Artificial Sequence
  derived and/or modified sequence opt4 from hemagglutinin__InfluenzaA__AIR94116
auggagaccgccagccugaucaccauccugcugguggugaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccacccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacagcggcaccagcaaggccugcagcgacagcuucuacagaagcaugagauggcugacccagaaggacaacgccuaccccauccaggacgcccaguacaccaacaaccagggcaagaacauccuguucauguggggcaucaaccacccccccaccgacaccgcccagaccaaccuguacaccagaaccgacaccaccaccagcguggccaccgaggagaucaacagaaccuucaagccccugaucggccccagaccccuggugaacggccugaugggcagaaucaacuacuacuggagcgugcugaagcccggccagacccugagaaucaagagcaacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucaacgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 165293 - RNA, 1701 nt, Artificial Sequence
  derived and/or modified sequence opt4 from hemagglutinin__InfluenzaA__AIT38333
augaagaccaucaucacccugagcuacauccugugccacguguucgcccagaagauccacggcagcgacagcagcaccgccacccugugccugggccaccacgccgugcccaacggcacccuggugaagaccaucaccaacgaccagaucgaggugaccaacgccaccgagcuggugcagagcagcagcaccggcagaaucugcgacaacccccacagaauccuggacggcaagaacugcacccugaucgacgcccugcugggcgacccccacugcgacgaguuccagaacaaggagugggaccuguucguggagagaagcaacgccuacagcgacugcuaccccuacuacgugcccgacuacgccagccugagaagccugguggccagcagcggcacccuggaguucaacaacgagagcuucaacuggaccggcaucagccaggacggcaccagcagcagcugcagaagaggcagcgugaagagcuucuucagcagacugaacuggcugcacggccuggaguacaaguaccccgcccagaacgugaccaugcugaacaacgacgaguucgacaagcuguacaucuggggcgugcaccaccccagcaccgacagcgaccagaccagccuguacgugcagaccagcggcagagugaccgugagcaccaagagaagccagcagaccgugauccccaacaucggcagcagacccugggugagaggcaucagcagcagaaucagcauccacuggaccaucgugaagcccggcgacauccugcugaucaacagcaccggcaaccugaucgcccccagaggcuacuucaagaucagaggcggcaagagcagcaucaugagaagcgacgcccccaucgacaacugcgacagcgagugcgugacccccaacggcaacauccccaacgacaagcccuuccagaacgugaacagaaucaccuacggccccugccccagauacaucaagcagaacacccugaagcuggccaccggcaugagaaacgugcccgagaagcagaccagaggcgugcugggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucggcaagaccaacgagaaguuccaccagaucgagaaggaguucagcgagaucgagggcagagugcaggaccuggagaaguacguggaggacaccaagaucgaccuguggagcuacaacgccgagcugcugguggugcuggagaaccagcacaccaucgaccugaccgacagcgagaugaacaagcuguucgagagaaccagaagacagcugagagagaacgccgaggacaugggcaacggcugcuucaagaucuaccacaagugcgacaacgccugcaucggcagcaucagaaacggcaccuacgugcacgacguguacagagacgaggcccugaacaacagauuccagaucaagggcguggagcugaagagcggcuacaaggacuggauccuguggaucagcuucgccaucagcugcuuccugcugugcgccgugcugcugggcuucaucaccugggccugccagaagggcaacaucagaugcaacaucugcaucuga

SEQ ID NO: 165294 - RNA, 1698 nt, Artificial Sequence
  derived and/or modified sequence opt4 from hemagglutinin__InfluenzaA__AIT38344
augaagaucaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugagaggcaucgccccccugcagcugggcaacugcagcguggccggcuggauccugggcaaccccgagugcgagagccugaucagcaaggagagcuggagcuacaucguggagaagcccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagcuacaacggcaagggcaacuucuacaagaaccugcuguggcugaccagaaagaacggccuguaccccaaccugagcaagagcuacaccaacaacaaggagaaggaggugcugauccuguggggcgugcaccaccccagcaacaucaaggaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgaggccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacaaggagagcacccagaacgccaucaacggcaucaccaacaaggugaacagcgugaucgagaagaugaacacccaguucaccaccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagauccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165295 - RNA, 1698 nt, Artificial Sequence
  derived and/or modified sequence opt4 from hemagglutinin__InfluenzaA__AIT38360
augaagaucaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagaagcccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagcuacaacggcaagggcaacuucuacaagaaccugcuguggcugaccagaaagaacggccuguaccccaaccugagcaagagcuacaccaacaacaaggagaaggaggugcugauccuguggggcgugcaccaccccagcaacaucgaggaccagagaacccuguaccacaccgagaacgccuacgugagcguggugagcagccacuacagcagaagauucacccccgagaucaccaagagacccaaggugagaggccaggagggcagaaucaacuacuacuggacccugcuggagcccggcgacaccaucaucuucgaggccaacggcaaccugaucgcccccugguacgccuucgcccugagcagaggccugggcagcggcaucaucaccagcaacgcccccauggacgagugcgaggccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacaaggagagcacccagaacgccaucaacggcaucaccaacaaggugaacagcgugaucgagaagaugaacacccaguucaccaccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165296 - RNA, 1701 nt, Artificial Sequence; identical to SEQ ID NO: 162560
  derived and/or modified sequence opt4 from hemagglutinin__InfluenzaA__AIT93147

SEQ ID NO: 165297 - RNA, 1701 nt, Artificial Sequence; identical to SEQ ID NO: 155189
  derived and/or modified sequence opt4 from hemagglutinin__InfluenzaA__AIU39700

SEQ ID NO: 165298 - RNA, 1701 nt, Artificial Sequence
  derived and/or modified sequence opt4 from hemagglutinin__InfluenzaA__AIU39702
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagcuuccccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165299 - RNA, 1701 nt, Artificial Sequence; identical to SEQ ID NO: 159429
  derived and/or modified sequence opt4 from hemagglutinin__InfluenzaA__AIU39704

SEQ ID NO: 165300 - RNA, 1704 nt, Artificial Sequence
  derived and/or modified sequence opt4 from hemagglutinin__InfluenzaA__AIU46609
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaaccccaugugcgacgaguucaucagagugcccgaguggagcuacaucguggagagagccaaccccgccaacgaccugugcuaccccggcaaccugaacgacuacgaggagcugaagcaccugcugagcagaaucaaccacuucgagaagauccugaucauccccaagagcagcuggaccaaccacgagaccagccugggcgugagcgccgccugccccuaccagggcacccccagcuucuucagaaacgugguguggcugaucaagaagaacgacgccuaccccaccaucaagaucagcuacaacaacaccaaccaggaggaccugcugauccuguggggcauccaccacagcaacaacgccgccgagcagaccaaccuguacaagaaccccaccaccuacaucagcgugggcaccagcacccugaaccagagacuggugcccaagaucgccaccagaagccaggugaacggccagagaggcagaauggacuucuucuggaccauccugaagcccaacgacgccauccacuucgagagcaacggcaacuucaucgcccccgaguacgccuacaagaucgugaagaagggcgacagcaccaucaugaagagcgagguggaguacggccacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagaagagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaucguggccggccugagccuguggaugugcagcaacggcagccugcagugcagaaucugcaucuga

SEQ ID NO: 165301 - RNA, 1689 nt, Artificial Sequence
  derived and/or modified sequence opt4 from hemagglutinin__InfluenzaA__AIU46714
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccaaguacagccugugcuaccccggcagcuucaacgacuacgaggagcugaagcaccugcugagcagcgugaagcacuucgagaaggugaagauccugcccaaggacggcuggacccagcacaagaccgacggcggcagcaaggccugcgccgugagcggcaagcagagcuucuucagaaacaugguguggcugaccaagaagggccagaacuaccccguggccaagagaagcuacaacaacaccagcggcgagcagaugcugaucaucuggggcgugcaccaccccaacgacgaggaggagcagagagcccuguaccagaaggugggcaccuacgugagcgccagcaccagcacccugaacaagagaagcacccccgagaucgccgccagacccgaggugaacggccugggcagcagaauggaguucagcuggacccugcuggacgugugggacaccaucaacuucgagagcaccggcaaccugguggcccccgaguacggcuucaagaucagcaagagaggcagcagcggcaucaucaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacagaaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacaacgagugcaugaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugaucgccggcaucagcuucuggaugugcagcaacggcagccugcagugcagaaucugcaucuga

SEQ ID NO: 165302 - RNA, 1701 nt, Artificial Sequence
  derived and/or modified sequence opt4 from hemagglutinin__InfluenzaA__AIV09219
augaaggccauccugguggugcugcuguacaccuucgccaccaccaacgccgacauccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagcugcugagcaccaccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccggcagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagacuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaccagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgacaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165303 - RNA, 1701 nt, Artificial Sequence
  derived and/or modified sequence opt4 from hemagglutinin__InfluenzaA__AIW60689
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcgacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagcaucuacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacuacgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacgccuacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165304 - RNA, 1701 nt, Artificial Sequence
  derived and/or modified sequence opt4 from hemagglutinin__InfluenzaA__AIW60690
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcgacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacuacgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacgccuacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165305 - RNA, 1701 nt, Artificial Sequence
  derived and/or modified sequence opt4 from hemagglutinin__InfluenzaA__AIW60691
augaagaccaucaucgcccugagcuacauccugugccugguguucgcccagaagcugcccggcaacgacaacagcaccgccacccugugccugggccaccacgccgugcccaacggcacccuggugaaggccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcgacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagacuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165306 - RNA, 1701 nt, Artificial Sequence
  derived and/or modified sequence opt4 from hemagglutinin__InfluenzaA__AIW60692
augaagaccaucaucgcccugagcuacauccugugccugguguucgcccagaagcugcccggcaacgacaacagcaccgccacccugugccugggccaccacgccgugcccaacggcacccuggugaaggccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcgacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165307 - RNA, 1701 nt, Artificial Sequence
  derived and/or modified sequence opt4 from hemagglutinin__InfluenzaA__AIW60693
augaagaccaucaucgcccugagcuacauccugugccugguguucgcccagaagcugcccggcaacgacaacagcaccgccacccugugccugggccaccacgccgugcugaacggcacccuggugaagaccaucaccaacgaccagaucgaggugaccaacgccaccgagcuggugcagaacagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaccagcaucuacgcccaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165308 - RNA, 1701 nt, Artificial Sequence
  derived and/or modified sequence opt4 from hemagglutinin__InfluenzaA__AIW60694
augaagaccaucaucgcccugagcuacauccugugccugguguucgcccagaagcugcccggcaacgacaacagcaccgccacccugugccugggccaccacgccgugcugaacggcacccuggugaagaccaucaccaacgaccagaucgaggugaccaacgccaccgagcuggugcagaacagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165309 - RNA, 1701 nt, Artificial Sequence
  derived and/or modified sequence opt4 from hemagglutinin__InfluenzaA__AIW60695
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaacuacaaguaccccgcccugaacgugaccaugcccaacaacgagaaguucgacaagcuguacaucuggggcgugcaccaccccagcaccgacagcgaccagaucagcaucuacgcccaggcccccggcagagugaccgugagcaccaagagaagccagcagaccgugauccccaacaucggcagcagacccugggugagaggcgugagcagcaucaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165310 - RNA, 1701 nt, Artificial Sequence
  derived and/or modified sequence opt4 from hemagglutinin__InfluenzaA__AIW60696
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggaccagaacggcaccagcagcgccugcaagagaagaagcaacaagagcuucuucagcagacugaacuggcugcaccagcugaaguacaaguaccccgcccugaacguggccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 165311 - RNA, 1701 nt, Artificial Sequence
  derived and/or modified sequence opt4 from hemagglutinin__InfluenzaA__AIW60697
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcagcugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccgacaccgacagcgugcagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165312 - RNA, 1701 nt, Artificial Sequence
  derived and/or modified sequence opt4 from hemagglutinin__InfluenzaA__AIW60698
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165313 - RNA, 1701 nt, Artificial Sequence
  derived and/or modified sequence opt4 from hemagglutinin__InfluenzaA__AIW60699
augaagaccaucaucgcccugagcuacauccugugccugguguucgcccagaagcugcccggcaacgacaacagcaccgccacccugugcaucggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgaggaguucgacaagcuguacaucuggggcgugcaccaccccgugaccgacaacgaccagaucagccuguacgcccaggccagcggcaagaucaccgugagcaccaagagaagccagcagaccgugauccccaacaucggcagcagacccagagugagagacauccccagcagaaucagcaucuacuggaccaucgugaagcccggcgacauccugcugaucaagagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgaggagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165314 - RNA, 1701 nt, Artificial Sequence
  derived and/or modified sequence opt4 from hemagglutinin__InfluenzaA__AIW60700
augaagaccaucaucgcccugagcuacauccugugccugguguucgcccagaagcugcccggcaacgacaacagcaccgccacccugugcaucggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggccagcggcaagaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgaggagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165315 - RNA, 1701 nt, Artificial Sequence
  derived and/or modified sequence opt4 from hemagglutinin__InfluenzaA__AIW60701
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccccuacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165316 - RNA, 1701 nt, Artificial Sequence
  derived and/or modified sequence opt4 from hemagglutinin__InfluenzaA__AIW60702
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165317 - RNA, 1701 nt, Artificial Sequence; identical to SEQ ID NO: 165061
  derived and/or modified sequence opt4 from hemagglutinin__InfluenzaA__AIZ07211

SEQ ID NO: 165318 - RNA, 1701 nt, Artificial Sequence
  derived and/or modified sequence opt4 from hemagglutinin__InfluenzaA__AIZ07212
augaagaccaucauggcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165319 - RNA, 1683 nt, Artificial Sequence
  derived and/or modified sequence opt4 from hemagglutinin__InfluenzaA__AJD78175
auggagaccgccagccugaucaccauccugcugguggugaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugcugcugggcggcagagaguggagcuacaucguggagagacccagcgccgccaacggccugugcuaccccggcaacguggagaaccuggaggagcugagaagccuguucagcagcgccagaagcuaccagagaauccagaucuuccccgacaccaucuggaacgugagcuacagcggcaccagcaaggccugcagcgacagcuucuacagaagcaugagauggcugacccagaaggacaacaccuaccccauccaggacgcccaguacaccaacaaccagggcaagaacauccuguucauguggggcaucaaccacccccccaccgacaccgcccagaccaaccuguacaccagaaccgacaccaccaccagcguggccaccgaggagaucaacagaaccuucaagccccugaucggccccagaccccuggugaacggccugaugggcagaaucaacuacuacuggagcgugcugaagcccggccagacccugagaaucaagagcaacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucaacgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 165320 - RNA, 1683 nt, Artificial Sequence
  derived and/or modified sequence opt4 from hemagglutinin__InfluenzaA__AJD78187
auggagaccgccagccugaucaccauccugcugguggugaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccacccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacagcggcaccagcaagaccugcagcgacagcuucuacagaagcaugagauggcugacccagaaggacaacgccuaccccauccaggacgcccaguacaccaacaaccagggcaagaacauccuguucauguggggcaucaaccacccccccaccgacaccacccagaccaaccuguacaccagaaccgacaccaccaccagcguggccaccgaggagaucaacagaaccuucaagccccugaucggccccagaccccuggugaacggccugaugggcagaaucaacuacuacuggagcgugcugaagcccggccagacccugagaaucaagagcaacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 165321 - RNA, 1683 nt, Artificial Sequence
  derived and/or modified sequence opt4 from hemagglutinin__InfluenzaA__AJD78199
auggagaccgugagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugagccuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacgacggcaccagcaccgccugcagcggcagcuucuacagaagcaugagauggcugaccagaaagaacggcgacuaccccauccaggacgcccaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 165322 - RNA, 1683 nt, Artificial Sequence
  derived and/or modified sequence opt4 from hemagglutinin__InfluenzaA__AJD78211
auggagaccgugagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugagccuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacgacggcaccagcaccgccugcagcggcagcuucuacagaagcaugagauggcugaccagaaagaacggcgacuaccccauccaggacgcccaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagaagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 165323 - RNA, 1689 nt, Artificial Sequence
  derived and/or modified sequence opt4 from hemagglutinin__InfluenzaA__AJI76401
auggccaucaucuaccugauccugcuguucgccaccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagccugaacgacuacgaggagcugaagcaccugcugagcagcgugaagcacuucgagaaggugagaauccugcccaaggacagauggaccaaccacaccaccaccggcggcagcaaggccugcgccgugagcggcaagcccagcuucuucagaaacaugguguggcugaccaagaagggccccaacuaccccguggccaagggcagcuacaacaacaccagcggcgagcagaugcugaucaucuggggcgugcaccaccccaucgacgaggccgagcagagagcccuguaccagaacgugggcaccuacgugagcgccagcaccagcacccuguacaagagaagcauccccgagaucgccgccagacccgaggugaacggccugggcagcagaauggaguucagcuggacccugcuggacgugugggacaccaucaacuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucaacaaccuggagaagagacuggagaaccugaacaagagaauggaggacggcuuccuggacguguggaccuacaacgccgagcugcuggugcugauggagaacgagagaacccuggacuuccacgacagcaacgugaagaaccuguacgagaaggugagaaugcagcugagagacaacgugagagagcugggcaacggcugcuucgaguucuaccacaagugcgacgacgagugcaugaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugguggccggcaucagcuucuggaugugcagcaacggcagccugcagugcagaaucugcaucuga

SEQ ID NO: 165324 - RNA, 1701 nt, Artificial Sequence; identical to SEQ ID NO: 164585
  derived and/or modified sequence opt4 from hemagglutinin__InfluenzaA__AJI80137

SEQ ID NO: 165325 - RNA, 1701 nt, Artificial Sequence; identical to SEQ ID NO: 164585
  derived and/or modified sequence opt4 from hemagglutinin__InfluenzaA__AJI80149

SEQ ID NO: 165326 - RNA, 1701 nt, Artificial Sequence; identical to SEQ ID NO: 162560
  derived and/or modified sequence opt4 from hemagglutinin__InfluenzaA__AJI80161

SEQ ID NO: 165327 - RNA, 1701 nt, Artificial Sequence
  derived and/or modified sequence opt4 from hemagglutinin__InfluenzaA__AJI80172
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcagccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165328 - RNA, 1701 nt, Artificial Sequence
  derived and/or modified sequence opt4 from hemagglutinin__InfluenzaA__AJI80196
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacaucaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgaguuccugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165329 - RNA, 1701 nt, Artificial Sequence; identical to SEQ ID NO: 165135
  derived and/or modified sequence opt4 from hemagglutinin__InfluenzaA__AJI80208

SEQ ID NO: 165330 - RNA, 1701 nt, Artificial Sequence; identical to SEQ ID NO: 162514
  derived and/or modified sequence opt4 from hemagglutinin__InfluenzaA__AJI80220

SEQ ID NO: 165331 - RNA, 1701 nt, Artificial Sequence; identical to SEQ ID NO: 165327
  derived and/or modified sequence opt4 from hemagglutinin__InfluenzaA__AJI80232

SEQ ID NO: 165332 - RNA, 1701 nt, Artificial Sequence; identical to SEQ ID NO: 162514
  derived and/or modified sequence opt4 from hemagglutinin__InfluenzaA__AJI80244

SEQ ID NO: 165333 - RNA, 1701 nt, Artificial Sequence; identical to SEQ ID NO: 162378
  derived and/or modified sequence opt4 from hemagglutinin__InfluenzaA__AJI80256

SEQ ID NO: 165334 - RNA, 1701 nt, Artificial Sequence; identical to SEQ ID NO: 162514
  derived and/or modified sequence opt4 from hemagglutinin__InfluenzaA__AJI80268

SEQ ID NO: 165335 - RNA, 1701 nt, Artificial Sequence
  derived and/or modified sequence opt4 from hemagglutinin__InfluenzaA__AJI80280
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcaagaucugcgacagcccccaccagauccuggacggcgagaacugcacccugaucgacgcccugcugggcgacccccagugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165336 - RNA, 1701 nt, Artificial Sequence; identical to SEQ ID NO: 165107
  derived and/or modified sequence opt4 from hemagglutinin__InfluenzaA__AJI80292

SEQ ID NO: 165337 - RNA, 1701 nt, Artificial Sequence; identical to SEQ ID NO: 165135
  derived and/or modified sequence opt4 from hemagglutinin__InfluenzaA__AJI80303

SEQ ID NO: 165338 - RNA, 1701 nt, Artificial Sequence; identical to SEQ ID NO: 165107
  derived and/or modified sequence opt4 from hemagglutinin__InfluenzaA__AJI80315

SEQ ID NO: 165339 - RNA, 1701 nt, Artificial Sequence
  derived and/or modified sequence opt4 from hemagglutinin__InfluenzaA__AJI80326
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagaagaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165340 - RNA, 1701 nt, Artificial Sequence
  derived and/or modified sequence opt4 from hemagglutinin__InfluenzaA__AJI80337
augaaggccauccugguggugcugcuguacaccuucgccaccgccaacgccgacacccugugcaucggcuaccacgccaacaacagcaccgacaccguggacaccgugcuggagaagaacgugaccgugacccacagcaucaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccaacgccuacguguucgugggcaccagcaaguacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165341 - RNA, 1701 nt, Artificial Sequence; identical to SEQ ID NO: 162514
  derived and/or modified sequence opt4 from hemagglutinin__InfluenzaA__AJI80348

SEQ ID NO: 165342 - RNA, 1701 nt, Artificial Sequence; identical to SEQ ID NO: 162378
  derived and/or modified sequence opt4 from hemagglutinin__InfluenzaA__AJI80360

SEQ ID NO: 165343 - RNA, 1701 nt, Artificial Sequence; identical to SEQ ID NO: 162378
  derived and/or modified sequence opt4 from hemagglutinin__InfluenzaA__AJI80372

SEQ ID NO: 165344 - RNA, 1701 nt, Artificial Sequence; identical to SEQ ID NO: 162560
  derived and/or modified sequence opt4 from hemagglutinin__InfluenzaA__AJI80384

SEQ ID NO: 165345 - RNA, 1701 nt, Artificial Sequence; identical to SEQ ID NO: 162560
  derived and/or modified sequence opt4 from hemagglutinin__InfluenzaA__AJI80395

SEQ ID NO: 165346 - RNA, 1701 nt, Artificial Sequence; identical to SEQ ID NO: 162560
  derived and/or modified sequence opt4 from hemagglutinin__InfluenzaA__AJI80406

SEQ ID NO: 165347 - RNA, 1701 nt, Artificial Sequence; identical to SEQ ID NO: 162560
  derived and/or modified sequence opt4 from hemagglutinin__InfluenzaA__AJI80417

SEQ ID NO: 165348 - RNA, 1701 nt, Artificial Sequence; identical to SEQ ID NO: 162560
  derived and/or modified sequence opt4 from hemagglutinin__InfluenzaA__AJI80428

SEQ ID NO: 165349 - RNA, 1701 nt, Artificial Sequence; identical to SEQ ID NO: 162514
  derived and/or modified sequence opt4 from hemagglutinin__InfluenzaA__AJI80439

SEQ ID NO: 165350 - RNA, 1701 nt, Artificial Sequence; identical to SEQ ID NO: 162514
  derived and/or modified sequence opt4 from hemagglutinin__InfluenzaA__AJI80462

SEQ ID NO: 165351 - RNA, 1701 nt, Artificial Sequence
  derived and/or modified sequence opt4 from hemagglutinin__InfluenzaA__AJI80474
augaaggccauccugguggugcugcuguacaccuucgccaccgccaacgccgacacccugugcaucggcuaccacgccaacaacagcaccgacaccguggacaccgugcuggagaagaacgugaccgugacccacagcaucaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165352 - RNA, 1701 nt, Artificial Sequence; identical to SEQ ID NO: 165351
  derived and/or modified sequence opt4 from hemagglutinin__InfluenzaA__AJI80485

SEQ ID NO: 165353 - RNA, 1701 nt, Artificial Sequence; identical to SEQ ID NO: 162560
  derived and/or modified sequence opt4 from hemagglutinin__InfluenzaA__AJI80496

SEQ ID NO: 165354 - RNA, 1701 nt, Artificial Sequence; identical to SEQ ID NO: 165163
  derived and/or modified sequence opt4 from hemagglutinin__InfluenzaA__AJI80507

SEQ ID NO: 165355 - RNA, 1701 nt, Artificial Sequence; identical to SEQ ID NO: 162560
  derived and/or modified sequence opt4 from hemagglutinin__InfluenzaA__AJI80518

SEQ ID NO: 165356 - RNA, 1701 nt, Artificial Sequence; identical to SEQ ID NO: 160652
  derived and/or modified sequence opt4 from hemagglutinin__InfluenzaA__AJJ98765

SEQ ID NO: 165357 - RNA, 1701 nt, Artificial Sequence
  derived and/or modified sequence opt4 from hemagglutinin__InfluenzaA__AJJ98777
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcuucagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165358 - RNA, 1701 nt, Artificial Sequence; identical to SEQ ID NO: 161973
  derived and/or modified sequence opt4 from hemagglutinin__InfluenzaA__AJJ98789

SEQ ID NO: 165359 - RNA, 1701 nt, Artificial Sequence
  derived and/or modified sequence opt4 from hemagglutinin__InfluenzaA__AJJ98801
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaaacaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165360 - RNA, 1701 nt, Artificial Sequence
  derived and/or modified sequence opt4 from hemagglutinin__InfluenzaA__AJJ98813
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccguggugcccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165361 - RNA, 1701 nt, Artificial Sequence
  derived and/or modified sequence opt4 from hemagglutinin__InfluenzaA__AJJ98825
augaagaccaucaucgcccugagcuacauccugugccugguguucgcccaggagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacacagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165362 - RNA, 1701 nt, Artificial Sequence
  derived and/or modified sequence opt4 from hemagglutinin__InfluenzaA__AJJ98837
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165363 - RNA, 1701 nt, Artificial Sequence
  derived and/or modified sequence opt4 from hemagglutinin__InfluenzaA__AJJ98849
augaagaccaucaucgcccugagcuacauccugugccugguguucgcccaggagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacugagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165364 - RNA, 1701 nt, Artificial Sequence
  derived and/or modified sequence opt4 from hemagglutinin__InfluenzaA__AJJ98861
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165365 - RNA, 1701 nt, Artificial Sequence
  derived and/or modified sequence opt4 from hemagglutinin__InfluenzaA__AJJ98873
augaagaccaucaucgcccugagcuacagccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165366 - RNA, 1701 nt, Artificial Sequence
  derived and/or modified sequence opt4 from hemagglutinin__InfluenzaA__AJJ98885
augaagaccaucaucgcccugagcaacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaaggagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165367 - RNA, 1701 nt, Artificial Sequence
  derived and/or modified sequence opt4 from hemagglutinin__InfluenzaA__AJJ98897
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165368 - RNA, 1701 nt, Artificial Sequence; identical to SEQ ID NO: 164290
  derived and/or modified sequence opt4 from hemagglutinin__InfluenzaA__AJJ98909

SEQ ID NO: 165369 - RNA, 1701 nt, Artificial Sequence
  derived and/or modified sequence opt4 from hemagglutinin__InfluenzaA__AJJ98921
augaagaccaucaucgcccugagcuacauccugugccugguguucgcccagaagcugcccggcaaggacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugaagcagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165370 - RNA, 1701 nt, Artificial Sequence; identical to SEQ ID NO: 161973
  derived and/or modified sequence opt4 from hemagglutinin__InfluenzaA__AJJ98933

SEQ ID NO: 165371 - RNA, 1701 nt, Artificial Sequence; identical to SEQ ID NO: 159502
  derived and/or modified sequence opt4 from hemagglutinin__InfluenzaA__AJJ98945

SEQ ID NO: 165372 - RNA, 1701 nt, Artificial Sequence
  derived and/or modified sequence opt4 from hemagglutinin__InfluenzaA__AJJ98957
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165373 - RNA, 1701 nt, Artificial Sequence; identical to SEQ ID NO: 154954
  derived and/or modified sequence opt4 from hemagglutinin__InfluenzaA__AJJ98969

SEQ ID NO: 165374 - RNA, 1701 nt, Artificial Sequence
  derived and/or modified sequence opt4 from hemagglutinin__InfluenzaA__AJJ98981
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccacauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165375 - RNA, 1701 nt, Artificial Sequence
  derived and/or modified sequence opt4 from hemagglutinin__InfluenzaA__AJJ98993
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacaacccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaugagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165376 - RNA, 1701 nt, Artificial Sequence
  derived and/or modified sequence opt4 from hemagglutinin__InfluenzaA__AJJ99005
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaucggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165377 - RNA, 1701 nt, Artificial Sequence; identical to SEQ ID NO: 155931
  derived and/or modified sequence opt4 from hemagglutinin__InfluenzaA__AJJ99017

SEQ ID NO: 165378 - RNA, 1701 nt, Artificial Sequence
  derived and/or modified sequence opt4 from hemagglutinin__InfluenzaA__AJJ99029
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165379 - RNA, 1701 nt, Artificial Sequence
  derived and/or modified sequence opt4 from hemagglutinin__InfluenzaA__AJJ99041
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcgacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccccuacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcggcugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165380 - RNA, 1701 nt, Artificial Sequence; identical to SEQ ID NO: 162378
  derived and/or modified sequence opt4 from hemagglutinin__InfluenzaA__AJJ99053

SEQ ID NO: 165381 - RNA, 1701 nt, Artificial Sequence; identical to SEQ ID NO: 162378
  derived and/or modified sequence opt4 from hemagglutinin__InfluenzaA__AJJ99065

SEQ ID NO: 165382 - RNA, 1701 nt, Artificial Sequence
  derived and/or modified sequence opt4 from hemagglutinin__InfluenzaA__AJJ99089
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaaacaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165383 - RNA, 1701 nt, Artificial Sequence; identical to SEQ ID NO: 162068
  derived and/or modified sequence opt4 from hemagglutinin__InfluenzaA__AJJ99101

SEQ ID NO: 165384 - RNA, 1701 nt, Artificial Sequence; identical to SEQ ID NO: 161973
  derived and/or modified sequence opt4 from hemagglutinin__InfluenzaA__AJJ99113

SEQ ID NO: 165385 - RNA, 1701 nt, Artificial Sequence
  derived and/or modified sequence opt4 from hemagglutinin__InfluenzaA__AJJ99125
augaagaccaucaucgcccugagcuacauccugugcaugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165386 - RNA, 1701 nt, Artificial Sequence
  derived and/or modified sequence opt4 from hemagglutinin__InfluenzaA__AJJ99137
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucgugagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165387 - RNA, 1701 nt, Artificial Sequence
  derived and/or modified sequence opt4 from hemagglutinin__InfluenzaA__AJJ99149
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacaugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccaggcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165388 - RNA, 1701 nt, Artificial Sequence
  derived and/or modified sequence opt4 from hemagglutinin__InfluenzaA__AJJ99161
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165389 - RNA, 1701 nt, Artificial Sequence
  derived and/or modified sequence opt4 from hemagglutinin__InfluenzaA__AJJ99173
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucagaaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165390 - RNA, 1701 nt, Artificial Sequence
  derived and/or modified sequence opt4 from hemagglutinin__InfluenzaA__AJJ99185
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagagccgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165391 - RNA, 1701 nt, Artificial Sequence; identical to SEQ ID NO: 161328
  derived and/or modified sequence opt4 from hemagglutinin__InfluenzaA__AJJ99197

SEQ ID NO: 165392 - RNA, 1701 nt, Artificial Sequence
  derived and/or modified sequence opt4 from hemagglutinin__InfluenzaA__AJJ99209
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaaagagcgacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggcccugcugggcuucaucaugugggccugccagaagggcaacaucagaugcaacaucugcaucuga

SEQ ID NO: 165393 - RNA, 1701 nt, Artificial Sequence
  derived and/or modified sequence opt4 from hemagglutinin__InfluenzaA__AJJ99221
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165394 - RNA, 1701 nt, Artificial Sequence; identical to SEQ ID NO: 154435
  derived and/or modified sequence opt4 from hemagglutinin__InfluenzaA__AJJ99233

SEQ ID NO: 165395 - RNA, 1701 nt, Artificial Sequence
  derived and/or modified sequence opt4 from hemagglutinin__InfluenzaA__AJJ99244
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165396 - RNA, 1701 nt, Artificial Sequence
  derived and/or modified sequence opt4 from hemagglutinin__InfluenzaA__AJJ99255
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaaccacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugccccagagccggcgccaagagcuucuacaagaaccugaucuggcuggugaagaagggcaacagcuaccccaagcugagcaagagcuacaucaacgacaagggcaaggaggugcuggugauguggggcauccaccaccccagcaccaccgccgaccagcagagccuguaccagaacgccgacgccuacguguucgugggcaccagcagauacagcaaggaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165397 - RNA, 1698 nt, Artificial Sequence
  derived and/or modified sequence opt4 from hemagglutinin__InfluenzaA__AJJ99267
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccaucaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccgugagcuucuggaugugcagcaacggcagccugcagugcagagugugcaucuga

SEQ ID NO: 165398 - RNA, 1701 nt, Artificial Sequence; identical to SEQ ID NO: 159570
  derived and/or modified sequence opt4 from hemagglutinin__InfluenzaA__AJJ99278

SEQ ID NO: 165399 - RNA, 1701 nt, Artificial Sequence; identical to SEQ ID NO: 159573
  derived and/or modified sequence opt4 from hemagglutinin__InfluenzaA__AJJ99289

SEQ ID NO: 165400 - RNA, 1698 nt, Artificial Sequence
  derived and/or modified sequence opt4 from hemagglutinin__InfluenzaA__AJJ99301
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagagccugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165401 - RNA, 1698 nt, Artificial Sequence
  derived and/or modified sequence opt4 from hemagglutinin__InfluenzaA__AJJ99324
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagagcggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165402 - RNA, 1701 nt, Artificial Sequence
  derived and/or modified sequence opt4 from hemagglutinin__InfluenzaA__AJJ99335
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcaacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaacggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165403 - RNA, 1701 nt, Artificial Sequence; identical to SEQ ID NO: 157305
  derived and/or modified sequence opt4 from hemagglutinin__InfluenzaA__AJJ99357

SEQ ID NO: 165404 - RNA, 1701 nt, Artificial Sequence; identical to SEQ ID NO: 159344
  derived and/or modified sequence opt4 from hemagglutinin__InfluenzaA__AJJ99368

SEQ ID NO: 165405 - RNA, 1701 nt, Artificial Sequence; identical to SEQ ID NO: 158955
  derived and/or modified sequence opt4 from hemagglutinin__InfluenzaA__AJJ99379

SEQ ID NO: 165406 - RNA, 1701 nt, Artificial Sequence
  derived and/or modified sequence opt4 from hemagglutinin__InfluenzaA__AJJ99390
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165407 - RNA, 1701 nt, Artificial Sequence; identical to SEQ ID NO: 157305
  derived and/or modified sequence opt4 from hemagglutinin__InfluenzaA__AJJ99401

SEQ ID NO: 165408 - RNA, 1698 nt, Artificial Sequence
  derived and/or modified sequence opt4 from hemagglutinin__InfluenzaA__AJJ99413
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgccagcauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165409 - RNA, 1698 nt, Artificial Sequence; identical to SEQ ID NO: 156146
  derived and/or modified sequence opt4 from hemagglutinin__InfluenzaA__AJJ99425

SEQ ID NO: 165410 - RNA, 1698 nt, Artificial Sequence
  derived and/or modified sequence opt4 from hemagglutinin__InfluenzaA__AJJ99437
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccagccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165411 - RNA, 1698 nt, Artificial Sequence
  derived and/or modified sequence opt4 from hemagglutinin__InfluenzaA__AJJ99449
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165412 - RNA, 1698 nt, Artificial Sequence; identical to SEQ ID NO: 155008
  derived and/or modified sequence opt4 from hemagglutinin__InfluenzaA__AJJ99461

SEQ ID NO: 165413 - RNA, 1701 nt, Artificial Sequence
  derived and/or modified sequence opt4 from hemagglutinin__InfluenzaA__AJJ99483
augaaggccauccugcuggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugccccagagccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165414 - RNA, 1701 nt, Artificial Sequence; identical to SEQ ID NO: 159573
  derived and/or modified sequence opt4 from hemagglutinin__InfluenzaA__AJJ99494

SEQ ID NO: 165415 - RNA, 1701 nt, Artificial Sequence
  derived and/or modified sequence opt4 from hemagglutinin__InfluenzaA__AJJ99505
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaagggcuucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165416 - RNA, 1701 nt, Artificial Sequence; identical to SEQ ID NO: 155431
  derived and/or modified sequence opt4 from hemagglutinin__InfluenzaA__AJJ99516

SEQ ID NO: 165417 - RNA, 1701 nt, Artificial Sequence
  derived and/or modified sequence opt4 from hemagglutinin__InfluenzaA__AJJ99527
augaaggccauccugcuggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugccccagagccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgugaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165418 - RNA, 1701 nt, Artificial Sequence
  derived and/or modified sequence opt4 from hemagglutinin__InfluenzaA__AJJ99538
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165419 - RNA, 1701 nt, Artificial Sequence
  derived and/or modified sequence opt4 from hemagglutinin__InfluenzaA__AJJ99549
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 165420 - RNA, 1701 nt, Artificial Sequence; identical to SEQ ID NO: 159609
  derived and/or modified sequence opt4 from hemagglutinin__InfluenzaA__AJJ99560

SEQ ID NO: 165421 - RNA, 1701 nt, Artificial Sequence
  derived and/or modified sequence opt4 from hemagglutinin__InfluenzaA__AJJ99571
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacauccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165422 - RNA, 1701 nt, Artificial Sequence
  derived and/or modified sequence opt4 from hemagglutinin__InfluenzaA__AJJ99582
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaacggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165423 - RNA, 1701 nt, Artificial Sequence; identical to SEQ ID NO: 155431
  derived and/or modified sequence opt4 from hemagglutinin__InfluenzaA__AJJ99593

SEQ ID NO: 165424 - RNA, 1701 nt, Artificial Sequence
  derived and/or modified sequence opt4 from hemagglutinin__InfluenzaA__AJJ99604
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccagagugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165425 - RNA, 1698 nt, Artificial Sequence
  derived and/or modified sequence opt4 from hemagglutinin__InfluenzaA__AJJ99616
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccaaccagaagacccuguaccacaccgagaacgccuacgugagcguggugagcagccacuacagcagaaagcugacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165426 - RNA, 1698 nt, Artificial Sequence; identical to SEQ ID NO: 156146
  derived and/or modified sequence opt4 from hemagglutinin__InfluenzaA__AJJ99628

SEQ ID NO: 165427 - RNA, 1698 nt, Artificial Sequence
  derived and/or modified sequence opt4 from hemagglutinin__InfluenzaA__AJJ99640
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccaaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccguggccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165428 - RNA, 1698 nt, Artificial Sequence; identical to SEQ ID NO: 156146
  derived and/or modified sequence opt4 from hemagglutinin__InfluenzaA__AJJ99652

SEQ ID NO: 165429 - RNA, 1698 nt, Artificial Sequence
  derived and/or modified sequence opt4 from hemagglutinin__InfluenzaA__AJJ99664
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcaucgccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165430 - RNA, 1701 nt, Artificial Sequence
  derived and/or modified sequence opt4 from hemagglutinin__InfluenzaA__AJJ99675
augaaggccauccugcuggugcugcuguacaccuucgccaccgccaaggccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugccccagagccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccgacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165431 - RNA, 1701 nt, Artificial Sequence
  derived and/or modified sequence opt4 from hemagglutinin__InfluenzaA__AJJ99686
augaccgccauccugcuggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugccccagagccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165432 - RNA, 1701 nt, Artificial Sequence
  derived and/or modified sequence opt4 from hemagglutinin__InfluenzaA__AJJ99697
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgugauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165433 - RNA, 1701 nt, Artificial Sequence
  derived and/or modified sequence opt4 from hemagglutinin__InfluenzaA__AJJ99708
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgugauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165434 - RNA, 1701 nt, Artificial Sequence
  derived and/or modified sequence opt4 from hemagglutinin__InfluenzaA__AJJ99719
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgagggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165435 - RNA, 1701 nt, Artificial Sequence
  derived and/or modified sequence opt4 from hemagglutinin__InfluenzaA__AJJ99730
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguuccaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165436 - RNA, 1701 nt, Artificial Sequence; identical to SEQ ID NO: 159562
  derived and/or modified sequence opt4 from hemagglutinin__InfluenzaA__AJJ99741

SEQ ID NO: 165437 - RNA, 1701 nt, Artificial Sequence; identical to SEQ ID NO: 156353
  derived and/or modified sequence opt4 from hemagglutinin__InfluenzaA__AJJ99752

SEQ ID NO: 165438 - RNA, 1701 nt, Artificial Sequence; identical to SEQ ID NO: 155189
  derived and/or modified sequence opt4 from hemagglutinin__InfluenzaA__AJJ99763

SEQ ID NO: 165439 - RNA, 1698 nt, Artificial Sequence
  derived and/or modified sequence opt4 from hemagglutinin__InfluenzaA__AJJ99775
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaccgacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165440 - RNA, 1701 nt, Artificial Sequence
  derived and/or modified sequence opt4 from hemagglutinin__InfluenzaA__AJJ99786
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcgccguggccagcagccuggugcugguggugagccugggcgccaucagcuucuggaugugcagcaacggcagccugcagugcagaaucugcaucuga

SEQ ID NO: 165441 - RNA, 1698 nt, Artificial Sequence
  derived and/or modified sequence opt4 from hemagglutinin__InfluenzaA__AJJ99798
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagagacccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccaaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucauguucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165442 - RNA, 1698 nt, Artificial Sequence; identical to SEQ ID NO: 155008
  derived and/or modified sequence opt4 from hemagglutinin__InfluenzaA__AJJ99810

SEQ ID NO: 165443 - RNA, 1698 nt, Artificial Sequence
  derived and/or modified sequence opt4 from hemagglutinin__InfluenzaA__AJJ99822
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccuucauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165444 - RNA, 1701 nt, Artificial Sequence
  derived and/or modified sequence opt4 from hemagglutinin__InfluenzaA__AJJ99833
augaaggccauccugcuggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugccccagagccggcgccaagagcuucuacaagaaccugaucuggcuggugaagaagggcaacagcuaccugaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165445 - RNA, 1701 nt, Artificial Sequence; identical to SEQ ID NO: 159344
  derived and/or modified sequence opt4 from hemagglutinin__InfluenzaA__AJJ99844

SEQ ID NO: 165446 - RNA, 1701 nt, Artificial Sequence
  derived and/or modified sequence opt4 from hemagglutinin__InfluenzaA__AJJ99855
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacagcaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165447 - RNA, 1701 nt, Artificial Sequence
  derived and/or modified sequence opt4 from hemagglutinin__InfluenzaA__AJJ99866
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugaagggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165448 - RNA, 1701 nt, Artificial Sequence
  derived and/or modified sequence opt4 from hemagglutinin__InfluenzaA__AJJ99877
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugagaaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165449 - RNA, 1701 nt, Artificial Sequence
  derived and/or modified sequence opt4 from hemagglutinin__InfluenzaA__AJJ99888
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165450 - RNA, 1701 nt, Artificial Sequence
  derived and/or modified sequence opt4 from hemagglutinin__InfluenzaA__AJJ99899
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugccccagagccggcgccaagagcuucuacaagaaccugaucuggcuggugaagaagggcaacagcuaccccaaccugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugcuggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacggccagggcagcggcuacgccgccgaccugaagagcacccagaacgccguggacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165451 - RNA, 1701 nt, Artificial Sequence
  derived and/or modified sequence opt4 from hemagglutinin__InfluenzaA__AJJ99910
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcgacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165452 - RNA, 1701 nt, Artificial Sequence; identical to SEQ ID NO: 159344
  derived and/or modified sequence opt4 from hemagglutinin__InfluenzaA__AJJ99921

SEQ ID NO: 165453 - RNA, 1701 nt, Artificial Sequence
  derived and/or modified sequence opt4 from hemagglutinin__InfluenzaA__AJJ99932
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcgacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165454 - RNA, 1701 nt, Artificial Sequence; identical to SEQ ID NO: 158974
  derived and/or modified sequence opt4 from hemagglutinin__InfluenzaA__AJJ99943

SEQ ID NO: 165455 - RNA, 1701 nt, Artificial Sequence
  derived and/or modified sequence opt4 from hemagglutinin__InfluenzaA__AJJ99954
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagaaguucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaccagcgacacccccgugcacgacugcaacaccaccugccagacccccaagggcgccaucaacaccagccugcccuuccagaacauccaccccaucaccaucggcaacugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165456 - RNA, 1701 nt, Artificial Sequence; identical to SEQ ID NO: 155431
  derived and/or modified sequence opt4 from hemagglutinin__InfluenzaA__AJJ99965

SEQ ID NO: 165457 - RNA, 1698 nt, Artificial Sequence
  derived and/or modified sequence opt4 from hemagglutinin__InfluenzaA__AJJ99989
augaaggugaagcugcuggugcugcugugcaccuucaccgccaccuacgccgacaccaucugcaucggcuaccacgccaacaacagcaccgacaccguggacaccgugcuggagagaaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcaagaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagagaagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165458 - RNA, 1701 nt, Artificial Sequence
  derived and/or modified sequence opt4 from hemagglutinin__InfluenzaA__AJK00001
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugccccagagccggcgagaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165459 - RNA, 1701 nt, Artificial Sequence
  derived and/or modified sequence opt4 from hemagglutinin__InfluenzaA__AJK00012
augaaggccauccugguggugcugcugugcaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccaccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcgacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165460 - RNA, 1701 nt, Artificial Sequence
  derived and/or modified sequence opt4 from hemagglutinin__InfluenzaA__AJK00023
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugccccagagccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165461 - RNA, 1701 nt, Artificial Sequence; identical to SEQ ID NO: 159344
  derived and/or modified sequence opt4 from hemagglutinin__InfluenzaA__AJK00034

SEQ ID NO: 165462 - RNA, 1701 nt, Artificial Sequence; identical to SEQ ID NO: 159562
  derived and/or modified sequence opt4 from hemagglutinin__InfluenzaA__AJK00045

SEQ ID NO: 165463 - RNA, 1701 nt, Artificial Sequence; identical to SEQ ID NO: 159562
  derived and/or modified sequence opt4 from hemagglutinin__InfluenzaA__AJK00056

SEQ ID NO: 165464 - RNA, 1701 nt, Artificial Sequence; identical to SEQ ID NO: 155431
  derived and/or modified sequence opt4 from hemagglutinin__InfluenzaA__AJK00067

SEQ ID NO: 165465 - RNA, 1698 nt, Artificial Sequence
  derived and/or modified sequence opt4 from hemagglutinin__InfluenzaA__AJK00079
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccagaaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 165466 - RNA, 1698 nt, Artificial Sequence
  derived and/or modified sequence opt4 from hemagglutinin__InfluenzaA__AJK00091
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccaucaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgugcagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccgugagcuucuggaugugcagcaacggcagccugcagugcagagugugcaucuga

SEQ ID NO: 165467 - RNA, 1698 nt, Artificial Sequence; identical to SEQ ID NO: 155008
  derived and/or modified sequence opt4 from hemagglutinin__InfluenzaA__AJK00103

SEQ ID NO: 165468 - RNA, 1701 nt, Artificial Sequence; identical to SEQ ID NO: 159440
  derived and/or modified sequence opt4 from hemagglutinin__InfluenzaA__AJK00114

SEQ ID NO: 165469 - RNA, 1701 nt, Artificial Sequence
  derived and/or modified sequence opt4 from hemagglutinin__InfluenzaA__AJK00125
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagagagguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccguguacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165470 - RNA, 1701 nt, Artificial Sequence; identical to SEQ ID NO: 155189
  derived and/or modified sequence opt4 from hemagglutinin__InfluenzaA__AJK00136

SEQ ID NO: 165471 - RNA, 1704 nt, Artificial Sequence
  derived and/or modified sequence opt4 from hemagglutinin__InfluenzaA__AJK00166
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcaagcccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 165472 - RNA, 1707 nt, Artificial Sequence
  derived and/or modified sequence opt4 from hemagglutinin__InfluenzaA__AJK00177
auggagaagaucgugcugcugcuggccguggugagccuggugagaagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaaccugaacgacuacgaggagcugaagcaccugcugagcagaaucaaccacuucgagaagauccagaucauccccaagagcagcuggagcgaccacgaggccagccugggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgaggccgagcagaucaagcuguaccagaaccccaccaccuacgugagcgugggcaccagcacccugaaccagagacuggugcccaagaucgccaccagaagcaaggugaacggccagagcggcagaauggacuucuucuggaccauccugaagcccgacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagaagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 165473 - RNA, 1704 nt, Artificial Sequence
  derived and/or modified sequence opt4 from hemagglutinin__InfluenzaA__AJK00188
auggagaagaucgugcugcugcuggccguggugagccuggugagaagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaaccugaacgacuacgaggagcugaagcaccugcugagcagaaucaaccacuucgagaagauccagaucauccccaagagcagcuggagcgaccacgaggccagccugggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgaggccgagcagaucaagcuguaccagaaccccaccaccuacaucagcgugggcaccagcacccugaaccagagacuggugcccaagaucgccaccagaagcaaggugaacggccagagcggcagaauggacuucuucuggaccauccugaagcccgacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagaagagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 165474 - RNA, 1704 nt, Artificial Sequence
  derived and/or modified sequence opt4 from hemagglutinin__InfluenzaA__AJK00207
auggagaagaucgugcugcugcuggccaucgugagccuggugagaagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccagccaggaggaccugcuggugcuguggggcauccaccacagcaacgacgccaccgagcagaugaagcuguaccagaaccccaccaccuacgugagcgugggcaccagcacccugaaccagagacuggugcccaagaucgccaccagaagcaaggugaacggccagagcggcagaauggacuucuucuggaccauccugaagagcaacgacgccaucaacuucgagagcaacggcaacuucaucgcccccgaguacgccuacaagaucgugaagaagggcgacagcgccaucaugaagagcgagguggaguacggcaacugcagcaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacaccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 165475 - RNA, 1704 nt, Artificial Sequence
  derived and/or modified sequence opt4 from hemagglutinin__InfluenzaA__AJK00218
auggagaagaucgugcuguuccuggccaucgugagccuggugagaagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagaucagaaucauccccaagagcagcuggcccgaccacgaggccagcagcggcgugagcagcgccugccccuaccagggcacccccagcuucuucagaaacaucguguggcugaucaagaagaacaacaccuaccccaccaucaagagaagcuacaacaacaccagccaggaggaccugcuggugcuguggggcauccaccacagcagcgacgccaccgagcagaucaagcuguaccagaaccccaccaccuacgugagcgugggcaccagcacccugaaccagagacuggugcccaagaucgccaccagaagcaaggugaacggccagagcggcagaauggacuucuucuggaccauccugaagagcaacgacgccaucaacuucgagagcaacggcaacuucaucgcccccgaguacgccuacaagaucgugaagaagggcgacagcgccaucaugaagagcgagguggaguacggcaacugcagcaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccgccgccagcagccuggcccuggccaucaugguggccggccugagccuguggaugugcagcaacggcagccugcagugcagaaucugcaucuga

SEQ ID NO: 165476 - RNA, 1704 nt, Artificial Sequence
  derived and/or modified sequence opt4 from hemagglutinin__InfluenzaA__AJK00239
auggagaagaucgugcugcugcuggccaucgugagccuggugagaagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccagccaggaggaccugcuggugcuguggggcauccaccacagcaacgacgccaccgagcagaugaagcuguaccagaaccccaccaccuacgugagcgugggcaccagcacccugaaccagagacuggugcccaagaucgccaccagaagcaaggugaacggccagagcggcagaauggacuucuucuggaccauccugaagagcaacgacgccaucaacuucgagagcaacggcaacuucaucgcccccgaguacgccuacaagaucgugaagaagggcgacagcgccaucaugaagagcgagguggaguacggcaacugcagcaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 165477 - RNA, 1704 nt, Artificial Sequence
  derived and/or modified sequence opt4 from hemagglutinin__InfluenzaA__AJS18468
auggagaagaucgugcugcugcuggccguggugagccuggugaagagcgaccagaucugcaucggcuaccacgccaacaacagcaccgagcagguggacaccaucauggagaagaacgugaccgugacccacgcccaggacauccuggagaagacccacaacggcagacugugcgaccugaacggcgugaagccccugauccugaaggacugcagcguggccggcuggcugcugggcaaccccaugugcgacgaguucaucagagugcccgaguggagcuacaucguggagagagccaaccccgccaacgaccugugcuaccccggcaaccugaacgacuacgaggagcugaagcaccugcugagcagaaucaaccacuucgagaagacccugaucauccccaagagcagcuggcccaaccacgagaccagccugggcgugagcgccgccugccccuaccagggcgugcccagcuucuucagaaacgugguguggcugaccaagaagaacgacgccuaccccaccaucaagaugagcuacaacaacaccaacagagaggaccugcugauccuguggggcauccaccacagcaacaacgccgccgagcagaccaaccuguacaagaaccccaccaccuacgugagcgugggcaccagcacccugaaccagagacuggugcccaagaucgccaccagaagccaggugaacggccagagaggcagaauggacuucuucuggaccauccugaagcccaacgacgccauccacuucgagagcaacggcaacuucaucgcccccgaguacgccuacaagaucgugaagaagggcgacagcaccaucaugaagagcgagauggaguacggccacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacagagagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccugacccuggccaucaucguggccggccugagccuguggaugugcagcaacggcagccugcagugcagaaucugcaucuga

SEQ ID NO: 165478 - RNA, 1704 nt, Artificial Sequence
  derived and/or modified sequence opt4 from hemagglutinin__InfluenzaA__AJS18479
auggagaagaucgugcugcugcuggccguggugagccuggugaagagcgaccagaucugcaucggcuaccacgccaacaacagcaccgagcagguggacaccaucauggagaagaacgugaccgugacccacgcccaggacauccuggagaagacccacaacggcagacugugcgaccugaacggcgugaagccccugauccugaaggacugcagcguggccggcuggcugcugggcaaccccaugugcgacgaguucaucagagugcccgaguggagcuacaucguggagagagccaaccccgccaacgaccugugcuaccccggcaaccugaacgacuacgaggagcugaagcaccugcugagcagaaucaaccacuucgagaagacccugaucauccccaagagcagcuggcccaaccacgagaccagccugggcgugagcgccgccugccccuaccagggcaugcccagcuucuucagaaacgugguguggcugaccaagaagaacgacaccuaccccaccaucaagaugagcuacaacaacaccaacagagaggaccugcugauccuguggggcauccaccacagcaacaacgccgccgagcagaccaaccuguacaagaaccccaccaccuacgugagcgugggcaccgccacccugaaccagagacuggugcccaagaucgccaccagaagccaggugaacggccagagaggcagaauggacuucuucuggaccauccugaagcccaacgacgccauccacuucgagagcaacggcaacuucaucgcccccgaguacgccuacaagaucgugaagaagggcgacagcaccaucaugaagagcgagauggaguacggccacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacagagagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaucguggccggccugagccuguggaugugcagcaacggcagccugcagugcagaaucugcaucuga

SEQ ID NO: 165479 - RNA, 1704 nt, Artificial Sequence
  derived and/or modified sequence opt4 from hemagglutinin__InfluenzaA__AJY79339
auggagaagaucgugcugcugcuggccaucgugagcaucgugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaaccugaacgacuacgaggagcugaagcaccugcugagcagaaucaaccacuucgagaagauccagaucauccccaaggacagcuggagcgaccacgaggccagcggcgugagcagcgccugccccuaccagggcagaagcagcuucuucagaaacgugguguggcugaccaagaagaacgacgccuaccccaccaucaagaagagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacagcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagaagagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagagagccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 165480 - RNA, 1704 nt, Artificial Sequence
  derived and/or modified sequence opt4 from hemagglutinin__InfluenzaA__AJY79341
auggagaagaucgugcugcugcuggccaucgugagcaucgugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaaggacagcuggagcgaccacgagaccagcggcgugagcagcgccugccccuaccagggcagaagcagcuucuucagaaacgugguguggcugaccaagaagaacgacgccuaccccaccaucaagaagagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagaacggcagaauggaguucuucuggaccauccugaagagcaacgacgccaucaacuucgagagcaacggcaacuucaucgcccccgagaacgccuacaagaucgugaagaagggcgacagcaccaucaugagaagcgagcuggaguacagcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagaagagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagagagccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 165481 - RNA, 1704 nt, Artificial Sequence
  derived and/or modified sequence opt4 from hemagglutinin__InfluenzaA__AJY79342
auggagaagaucgugcugcugcuggccaucgugagcaucgugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaaggacagcuggagcgaccacgaggccagcggcgugagcagcgccugccccuaccagggcagaagcagcuucuucagaaacgugguguggcugaccaagaagaacgacgccuaccccaccaucaagaagagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacagcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagaagagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagagagccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 165482 - RNA, 1704 nt, Artificial Sequence
  derived and/or modified sequence opt4 from hemagglutinin__InfluenzaA__AJY79343
auggagaagaucgugcugcugcuggccaucgugagcaucgugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaaggacagcuggagcgaccacgaggccagcggcgugagcagcgccugccccuaccagggcagaagcagcuucuucagaaacgugguguggcugaccaagaagaacgacgccuaccccaccaucaagaagagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacagcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagaagagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagagagccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacgacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 165483 - RNA, 1704 nt, Artificial Sequence
  derived and/or modified sequence opt4 from hemagglutinin__InfluenzaA__AJY79345
auggagaagaucgugcugcugcuggccaucgugagcaucgugaagagcgaccagaucugcaucggcuaccacgccaacaacagcaccgagcagguggacaccaucauggagaagaacgugaccgugaccagagcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaaggacagcuggagcgaccacgaggccagcggcgugagcagcgccugccccuaccagggcagaagcagcuucuucagaaacgugguguggcugaccaagaagaacgacgccuaccccaccaucaagaagagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacagcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagaagagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagagagccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 165484 - RNA, 1701 nt, Artificial Sequence; identical to SEQ ID NO: 164961
  derived and/or modified sequence opt4 from hemagglutinin__InfluenzaA__AKA54643

SEQ ID NO: 165485 - RNA, 1701 nt, Artificial Sequence
  derived and/or modified sequence opt4 from hemagglutinin__InfluenzaA__AKA54650
augaagaccaucaucgcccugagcuacauccugugccugguguucacccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165486 - RNA, 1701 nt, Artificial Sequence
  derived and/or modified sequence opt4 from hemagglutinin__InfluenzaA__AKA54651
augaagaccaucaucgccuucagcugcauccugugccagaucagcgcccagaagcugcccggcagcgacaacagcauggccacccugugccugggccaccacgccgugcccaacggcacccuggugaagaccaucaccgacgaccagaucgaggugaccaacgccaccgagcuggugcagagcaccagcaagggcgagaucugcagcagcccccaccagauccuggacggcaagaacugcacccugaucgacgcccugcugggcgacccccacugcgacgacuuccagaacaagaagugggaccuguucguggagagaagcaccgccuacagcaacugcuaccccuacuacgugcccgacuacgccagccugagaagccugguggccagcagcggcacccuggaguucacccaggagagcuucaacuggaccggcguggcccaggacggcgccagcuacagcugcagaagagagagcgagaacagcuucuucagcagacugaacuggcuguacagccugaacuacaaguaccccgcccugaacgugaccaugcccaacaacgacaaguucgacaagcuguacaucuggggcgugcaccaccccggcaccgacaaggaccagaccagccuguacauccaggccagcggcagagugaccgugagcaccaaguggagccagcagaccgugauccccaacaucggcagcagacccuggaucagaggcgugagcagcaucaucagcaucuacuggaccaucgugaagcccggcgacauccugcugaucaacagcaccggcaaccugaucgcccccagaggcuacuucaagauccagagcggcaagagcagcaucaugagaagcgacgcccacaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaccggcaagcugaacagagugaucaagaagaccaacgagaaguuccaccagaucgagaaggaguucagcgagguggagggcagaauccaggaccuggagagauacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggccgugaacaacagauuccagaucaagggcgugcagcugaagcugggcuacaaggacuggauccuguggaucagcuucgccaucagcugcuuccugcugugcgccgugcugcugggcuucaucaugugggccugccagaagggcaacaucagaugcaacaucugcaucuga

SEQ ID NO: 165487 - RNA, 1701 nt, Artificial Sequence
  derived and/or modified sequence opt4 from hemagglutinin__InfluenzaA__AKA59351
augaaggccauccuggugauccugcuguacaccuucgccgccgccaacgccgacaccaucugcaucggcuaccacgccaacaacagcaccgacaccguggacaccgugcuggagaagaacgugaccgugacccacagcguggaccugcuggaggacaagcacaacggcagacugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgagagcaacaagggcgugaccgccgccugcccccaggccggcgccaagagcuucuacaagaaccugaucuggcuggugaagaaggagaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165488 - RNA, 1701 nt, Artificial Sequence
  derived and/or modified sequence opt4 from hemagglutinin__InfluenzaA__AKA59353
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcgagugcaacaucgccggcuggauccugggcaaccccgagugcgagagccugagcaccgccagcagcuggagcuacaucguggagacccccagcagcaacaacggcaccugcuaccccggcgacuucaucgacuacgaggagcugagagagcagcugagcagcgugagcagcuucgagagauucgagaucuuccccaacaccagcagcuggcccaaccacgacagcagcaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagaagcuguaccagaacgaggacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaacaucguggugcccagauacgccuucgccauggagagaaacgccggcagcggcaucaucaucagcgacacccccgugcacaacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuucgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacagaaagaucgacgacggcuuccuggacaucuggaccuacaacgccgagcugcugauccugcuggagaacgagagaacccuggacuaccacgacagcaacgugagaaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugaucgugagccugggcgccaucagcuucuggaugugcagcaacggcagccugcagugcagaaucugcaucuga

SEQ ID NO: 165489 - RNA, 1701 nt, Artificial Sequence
  derived and/or modified sequence opt4 from hemagglutinin__InfluenzaA__AKA59355
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccagaagcuucuacaagaaccugaucuggcuggugaagaagggcaacagcuaccccaagcugaaccagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaaccuggugaucgagaagaugaacacccaguucaccgccgugggcaaggaguucagccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaagaucagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaguguaccagauccuggccaucuacagcaccguggccagcagccuggugcugguggugagccugggcgccaucagcuucuggaugugcagcaacggcagccugcagugcagaaucugcaucuga

SEQ ID NO: 165490 - RNA, 1701 nt, Artificial Sequence
  derived and/or modified sequence opt4 from hemagglutinin__InfluenzaA__AKE37137
augaaggccagacugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaccagcuacaucaacgacaagggcaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccuucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 165491 - RNA, 1701 nt, Artificial Sequence
  derived and/or modified sequence opt4 from hemagglutinin__InfluenzaA__AKS48035
auggagaagauggugcugcugcuggccguggugagccuggugaagagcgaccagaucugcaucggcuaccacgccaacaacagcaccgagcagguggacaccaucauggagaagaacgugaccgugacccacgcccaggacauccuggagaagacccacaacggcagacugugcgaccugaacggcgugaagccccugauccugaaggacugcagcguggccggcuggcugcugggcaaccccaugugcgacgaguucaucagagugcccgaguggagcuacaucguggagagagccaaccccgccaacgaccugugcuaccccggcaaccugaacgacuacgaggagcugaagcaccugcugagcagaaucaaccacuucgagaagacccugaucauccccaagagcagcuggcccaaccacaccagcagcggcgugagcgccgccugccccuaccagggcaugcccagcuucuucagaaacgugguguggcugaccaagaagaacgacgccuaccccaccaucaagaugagcuacaacaacaccuacagagaggaccugcugauccuguggggcauccaccacagcaacaacgccgccgagcagaccaaccuguacaagaaccccaccaccuacgugagcgugggcaccagcacccugaaccagagacuggagcccaagaucgccaccagaagccaggugaacggccagagaggcagaauggacuucuucuggaccauccugaagcccaacgacgccauccacuucgagagcaacggcaacuucaucgcccccgaguacgccuacaagaucgugaagaagggcgacagcaccaucaugaagagcgagauggaguacggccacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacagagagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaucguggccggccugagccuguggaugugcagcaacggcagccugcagugcagaaucugcaucuga

SEQ ID NO: 165492 - RNA, 1701 nt, Artificial Sequence
  derived and/or modified sequence opt4 from hemagglutinin__InfluenzaA__ALA08472
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacguguggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165493 - RNA, 1701 nt, Artificial Sequence; identical to SEQ ID NO: 164961
  derived and/or modified sequence opt4 from hemagglutinin__InfluenzaA__ALA08475

SEQ ID NO: 165494 - RNA, 1701 nt, Artificial Sequence
  derived and/or modified sequence opt4 from hemagglutinin__InfluenzaA__ALA08478
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagagaugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165495 - RNA, 1701 nt, Artificial Sequence; identical to SEQ ID NO: 162514
  derived and/or modified sequence opt4 from hemagglutinin__InfluenzaA__ALA08479

SEQ ID NO: 165496 - RNA, 1701 nt, Artificial Sequence
  derived and/or modified sequence opt4 from hemagglutinin__InfluenzaA__ALA08481
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165497 - RNA, 1701 nt, Artificial Sequence; identical to SEQ ID NO: 165496
  derived and/or modified sequence opt4 from hemagglutinin__InfluenzaA__ALA08482

SEQ ID NO: 165498 - RNA, 1701 nt, Artificial Sequence
  derived and/or modified sequence opt4 from hemagglutinin__InfluenzaA__ALA08483
augaagaccaucaucggccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165499 - RNA, 1701 nt, Artificial Sequence
  derived and/or modified sequence opt4 from hemagglutinin__InfluenzaA__ALA08484
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccaucagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165500 - RNA, 1701 nt, Artificial Sequence
  derived and/or modified sequence opt4 from hemagglutinin__InfluenzaA__ALA08488
augaagaccaucaucgcccugagcuacauccugugccugguguucgcccagaagauccccggcaacggcaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165501 - RNA, 1701 nt, Artificial Sequence
  derived and/or modified sequence opt4 from hemagglutinin__InfluenzaA__ALA08490
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcaucgagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165502 - RNA, 1701 nt, Artificial Sequence
  derived and/or modified sequence opt4 from hemagglutinin__InfluenzaA__ALA08491
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacaugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165503 - RNA, 1701 nt, Artificial Sequence; identical to SEQ ID NO: 165501
  derived and/or modified sequence opt4 from hemagglutinin__InfluenzaA__ALA08492

SEQ ID NO: 165504 - RNA, 1701 nt, Artificial Sequence
  derived and/or modified sequence opt4 from hemagglutinin__InfluenzaA__ALA08493
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcagaagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcaucgagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165505 - RNA, 1701 nt, Artificial Sequence
  derived and/or modified sequence opt4 from hemagglutinin__InfluenzaA__ALA08494
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165506 - RNA, 1701 nt, Artificial Sequence; identical to SEQ ID NO: 165505
  derived and/or modified sequence opt4 from hemagglutinin__InfluenzaA__ALA08495

SEQ ID NO: 165507 - RNA, 1701 nt, Artificial Sequence; identical to SEQ ID NO: 165505
  derived and/or modified sequence opt4 from hemagglutinin__InfluenzaA__ALA08496

SEQ ID NO: 165508 - RNA, 1701 nt, Artificial Sequence; identical to SEQ ID NO: 164961
  derived and/or modified sequence opt4 from hemagglutinin__InfluenzaA__ALA08497

SEQ ID NO: 165509 - RNA, 1701 nt, Artificial Sequence; identical to SEQ ID NO: 164961
  derived and/or modified sequence opt4 from hemagglutinin__InfluenzaA__ALA08498

SEQ ID NO: 165510 - RNA, 1701 nt, Artificial Sequence
  derived and/or modified sequence opt4 from hemagglutinin__InfluenzaA__ALA08499
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165511 - RNA, 1701 nt, Artificial Sequence; identical to SEQ ID NO: 165494
  derived and/or modified sequence opt4 from hemagglutinin__InfluenzaA__ALA08501

SEQ ID NO: 165512 - RNA, 1701 nt, Artificial Sequence
  derived and/or modified sequence opt4 from hemagglutinin__InfluenzaA__ALA08502
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165513 - RNA, 1701 nt, Artificial Sequence; identical to SEQ ID NO: 165512
  derived and/or modified sequence opt4 from hemagglutinin__InfluenzaA__ALA08503

SEQ ID NO: 165514 - RNA, 1701 nt, Artificial Sequence; identical to SEQ ID NO: 164961
  derived and/or modified sequence opt4 from hemagglutinin__InfluenzaA__ALA08504

SEQ ID NO: 165515 - RNA, 1701 nt, Artificial Sequence; identical to SEQ ID NO: 164961
  derived and/or modified sequence opt4 from hemagglutinin__InfluenzaA__ALA08505

SEQ ID NO: 165516 - RNA, 1701 nt, Artificial Sequence; identical to SEQ ID NO: 164961
  derived and/or modified sequence opt4 from hemagglutinin__InfluenzaA__ALA08506

SEQ ID NO: 165517 - RNA, 1701 nt, Artificial Sequence; identical to SEQ ID NO: 164961
  derived and/or modified sequence opt4 from hemagglutinin__InfluenzaA__ALA08507

SEQ ID NO: 165518 - RNA, 1701 nt, Artificial Sequence
  derived and/or modified sequence opt4 from hemagglutinin__InfluenzaA__ALA08508
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165519 - RNA, 1701 nt, Artificial Sequence; identical to SEQ ID NO: 164961
  derived and/or modified sequence opt4 from hemagglutinin__InfluenzaA__ALA08509

SEQ ID NO: 165520 - RNA, 1701 nt, Artificial Sequence; identical to SEQ ID NO: 164961
  derived and/or modified sequence opt4 from hemagglutinin__InfluenzaA__ALA08510

SEQ ID NO: 165521 - RNA, 1701 nt, Artificial Sequence
  derived and/or modified sequence opt4 from hemagglutinin__InfluenzaA__ALA08511
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccagcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165522 - RNA, 1701 nt, Artificial Sequence; identical to SEQ ID NO: 164961
  derived and/or modified sequence opt4 from hemagglutinin__InfluenzaA__ALA08512

SEQ ID NO: 165523 - RNA, 1701 nt, Artificial Sequence; identical to SEQ ID NO: 164961
  derived and/or modified sequence opt4 from hemagglutinin__InfluenzaA__ALA08514

SEQ ID NO: 165524 - RNA, 1701 nt, Artificial Sequence; identical to SEQ ID NO: 164961
  derived and/or modified sequence opt4 from hemagglutinin__InfluenzaA__ALA08515

SEQ ID NO: 165525 - RNA, 1701 nt, Artificial Sequence; identical to SEQ ID NO: 164961
  derived and/or modified sequence opt4 from hemagglutinin__InfluenzaA__ALA08516

SEQ ID NO: 165526 - RNA, 1701 nt, Artificial Sequence; identical to SEQ ID NO: 165518
  derived and/or modified sequence opt4 from hemagglutinin__InfluenzaA__ALA08517

SEQ ID NO: 165527 - RNA, 1701 nt, Artificial Sequence; identical to SEQ ID NO: 164961
  derived and/or modified sequence opt4 from hemagglutinin__InfluenzaA__ALA08519

SEQ ID NO: 165528 - RNA, 1701 nt, Artificial Sequence
  derived and/or modified sequence opt4 from hemagglutinin__InfluenzaA__ALA08520
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagcccagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165529 - RNA, 1701 nt, Artificial Sequence; identical to SEQ ID NO: 162658
  derived and/or modified sequence opt4 from hemagglutinin__InfluenzaA__ALA08522

SEQ ID NO: 165530 - RNA, 1701 nt, Artificial Sequence
  derived and/or modified sequence opt4 from hemagglutinin__InfluenzaA__ALA08523
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaucggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165531 - RNA, 1701 nt, Artificial Sequence
  derived and/or modified sequence opt4 from hemagglutinin__InfluenzaA__ALA08524
augaagaccaucaucgcccugagcuacauccugugcaugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacugagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165532 - RNA, 1701 nt, Artificial Sequence; identical to SEQ ID NO: 164961
  derived and/or modified sequence opt4 from hemagglutinin__InfluenzaA__ALA08525

SEQ ID NO: 165533 - RNA, 1701 nt, Artificial Sequence; identical to SEQ ID NO: 164961
  derived and/or modified sequence opt4 from hemagglutinin__InfluenzaA__ALA08526

SEQ ID NO: 165534 - RNA, 1701 nt, Artificial Sequence; identical to SEQ ID NO: 165518
  derived and/or modified sequence opt4 from hemagglutinin__InfluenzaA__ALA08527

SEQ ID NO: 165535 - RNA, 1701 nt, Artificial Sequence
  derived and/or modified sequence opt4 from hemagglutinin__InfluenzaA__ALA08528
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuaccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagaugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165536 - RNA, 1701 nt, Artificial Sequence; identical to SEQ ID NO: 164961
  derived and/or modified sequence opt4 from hemagglutinin__InfluenzaA__ALA08529

SEQ ID NO: 165537 - RNA, 1701 nt, Artificial Sequence; identical to SEQ ID NO: 164961
  derived and/or modified sequence opt4 from hemagglutinin__InfluenzaA__ALA08530

SEQ ID NO: 165538 - RNA, 1701 nt, Artificial Sequence
  derived and/or modified sequence opt4 from hemagglutinin__InfluenzaA__ALA08531
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165539 - RNA, 1701 nt, Artificial Sequence; identical to SEQ ID NO: 164961
  derived and/or modified sequence opt4 from hemagglutinin__InfluenzaA__ALA08532

SEQ ID NO: 165540 - RNA, 1701 nt, Artificial Sequence; identical to SEQ ID NO: 164961
  derived and/or modified sequence opt4 from hemagglutinin__InfluenzaA__ALA08533

SEQ ID NO: 165541 - RNA, 1701 nt, Artificial Sequence; identical to SEQ ID NO: 164961
  derived and/or modified sequence opt4 from hemagglutinin__InfluenzaA__ALA08534

SEQ ID NO: 165542 - RNA, 1701 nt, Artificial Sequence; identical to SEQ ID NO: 164961
  derived and/or modified sequence opt4 from hemagglutinin__InfluenzaA__ALA08535

SEQ ID NO: 165543 - RNA, 1701 nt, Artificial Sequence; identical to SEQ ID NO: 165518
  derived and/or modified sequence opt4 from hemagglutinin__InfluenzaA__ALA08536

SEQ ID NO: 165544 - RNA, 1701 nt, Artificial Sequence; identical to SEQ ID NO: 165518
  derived and/or modified sequence opt4 from hemagglutinin__InfluenzaA__ALA08537

SEQ ID NO: 165545 - RNA, 1701 nt, Artificial Sequence; identical to SEQ ID NO: 165518
  derived and/or modified sequence opt4 from hemagglutinin__InfluenzaA__ALA08538

SEQ ID NO: 165546 - RNA, 1701 nt, Artificial Sequence; identical to SEQ ID NO: 164961
  derived and/or modified sequence opt4 from hemagglutinin__InfluenzaA__ALA08539

SEQ ID NO: 165547 - RNA, 1701 nt, Artificial Sequence; identical to SEQ ID NO: 165518
  derived and/or modified sequence opt4 from hemagglutinin__InfluenzaA__ALA08540

SEQ ID NO: 165548 - RNA, 1701 nt, Artificial Sequence; identical to SEQ ID NO: 165518
  derived and/or modified sequence opt4 from hemagglutinin__InfluenzaA__ALA08541

SEQ ID NO: 165549 - RNA, 1701 nt, Artificial Sequence; identical to SEQ ID NO: 165518
  derived and/or modified sequence opt4 from hemagglutinin__InfluenzaA__ALA08542

SEQ ID NO: 165550 - RNA, 1701 nt, Artificial Sequence
  derived and/or modified sequence opt4 from hemagglutinin__InfluenzaA__ALA08543
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgccauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165551 - RNA, 1701 nt, Artificial Sequence; identical to SEQ ID NO: 164961
  derived and/or modified sequence opt4 from hemagglutinin__InfluenzaA__ALA08545

SEQ ID NO: 165552 - RNA, 1701 nt, Artificial Sequence; identical to SEQ ID NO: 164961
  derived and/or modified sequence opt4 from hemagglutinin__InfluenzaA__ALA08546

SEQ ID NO: 165553 - RNA, 1701 nt, Artificial Sequence
  derived and/or modified sequence opt4 from hemagglutinin__InfluenzaA__ALA08548
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcguggcccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165554 - RNA, 1701 nt, Artificial Sequence
  derived and/or modified sequence opt4 from hemagglutinin__InfluenzaA__ALA08549
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaccggcgugaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165555 - RNA, 1701 nt, Artificial Sequence; identical to SEQ ID NO: 165518
  derived and/or modified sequence opt4 from hemagglutinin__InfluenzaA__ALA08550

SEQ ID NO: 165556 - RNA, 1701 nt, Artificial Sequence
  derived and/or modified sequence opt4 from hemagglutinin__InfluenzaA__ALA08551
augaagaccaucaucgcccugagcuacauccugugccugguguucgcccagaagcugcuggagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165557 - RNA, 1701 nt, Artificial Sequence; identical to SEQ ID NO: 165518
  derived and/or modified sequence opt4 from hemagglutinin__InfluenzaA__ALA08552

SEQ ID NO: 165558 - RNA, 1701 nt, Artificial Sequence; identical to SEQ ID NO: 165518
  derived and/or modified sequence opt4 from hemagglutinin__InfluenzaA__ALA08553

SEQ ID NO: 165559 - RNA, 1701 nt, Artificial Sequence
  derived and/or modified sequence opt4 from hemagglutinin__InfluenzaA__ALA08554
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaugagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165560 - RNA, 1701 nt, Artificial Sequence
  derived and/or modified sequence opt4 from hemagglutinin__InfluenzaA__ALA08555
augaagaccaucaucgcccugagcuacauccugugccugguguucgcccagaagcugcccgagaacgacaacagcaccgccacccugugccugggccaccacgccgugcccaacggcaccaucgugaagaccaucaccagcgaccagaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccagcaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165561 - RNA, 1701 nt, Artificial Sequence
  derived and/or modified sequence opt4 from hemagglutinin__InfluenzaA__ALA08556
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcaucacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165562 - RNA, 1701 nt, Artificial Sequence; identical to SEQ ID NO: 165518
  derived and/or modified sequence opt4 from hemagglutinin__InfluenzaA__ALA08557

SEQ ID NO: 165563 - RNA, 1701 nt, Artificial Sequence; identical to SEQ ID NO: 165518
  derived and/or modified sequence opt4 from hemagglutinin__InfluenzaA__ALA08558

SEQ ID NO: 165564 - RNA, 1701 nt, Artificial Sequence
  derived and/or modified sequence opt4 from hemagglutinin__InfluenzaA__ALA08559
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcgccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165565 - RNA, 1701 nt, Artificial Sequence; identical to SEQ ID NO: 164961
  derived and/or modified sequence opt4 from hemagglutinin__InfluenzaA__ALA08560

SEQ ID NO: 165566 - RNA, 1701 nt, Artificial Sequence
  derived and/or modified sequence opt4 from hemagglutinin__InfluenzaA__ALA08561
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaaggagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165567 - RNA, 1701 nt, Artificial Sequence
  derived and/or modified sequence opt4 from hemagglutinin__InfluenzaA__ALA08563
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagauccugagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165568 - RNA, 1701 nt, Artificial Sequence
  derived and/or modified sequence opt4 from hemagglutinin__InfluenzaA__ALA08571
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 165569 - RNA, 1701 nt, Artificial Sequence; identical to SEQ ID NO: 165504
  derived and/or modified sequence opt4 from hemagglutinin__InfluenzaA__ALA08572

SEQ ID NO: 165570 - RNA, 1701 nt, Artificial Sequence; identical to SEQ ID NO: 165501
  derived and/or modified sequence opt4 from hemagglutinin__InfluenzaA__ALA08573

SEQ ID NO: 165571 - RNA, 1701 nt, Artificial Sequence
  derived and/or modified sequence opt4 from hemagglutinin__InfluenzaA__ALA08574
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucagcggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165572 - RNA, 1701 nt, Artificial Sequence
  derived and/or modified sequence opt4 from hemagglutinin__InfluenzaA__ALA08575
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165573 - RNA, 1701 nt, Artificial Sequence; identical to SEQ ID NO: 164961
  derived and/or modified sequence opt4 from hemagglutinin__InfluenzaA__ALA08576

SEQ ID NO: 165574 - RNA, 1701 nt, Artificial Sequence; identical to SEQ ID NO: 164961
  derived and/or modified sequence opt4 from hemagglutinin__InfluenzaA__ALA08577

SEQ ID NO: 165575 - RNA, 1701 nt, Artificial Sequence
  derived and/or modified sequence opt4 from hemagglutinin__InfluenzaA__ALA08579
augaagaccaucaucgcccugagcuacauccugugccugaucuucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165576 - RNA, 1701 nt, Artificial Sequence
  derived and/or modified sequence opt4 from hemagglutinin__InfluenzaA__ALA08580
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165577 - RNA, 1701 nt, Artificial Sequence
  derived and/or modified sequence opt4 from hemagglutinin__InfluenzaA__ALA08582
augaagaccaucaucgcccugagcuacauccugugccugguguucgcccagaagcugcccgagaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165578 - RNA, 1701 nt, Artificial Sequence; identical to SEQ ID NO: 165577
  derived and/or modified sequence opt4 from hemagglutinin__InfluenzaA__ALA08583

SEQ ID NO: 165579 - RNA, 1701 nt, Artificial Sequence; identical to SEQ ID NO: 165577
  derived and/or modified sequence opt4 from hemagglutinin__InfluenzaA__ALA08584

SEQ ID NO: 165580 - RNA, 1701 nt, Artificial Sequence; identical to SEQ ID NO: 165577
  derived and/or modified sequence opt4 from hemagglutinin__InfluenzaA__ALA08585

SEQ ID NO: 165581 - RNA, 1701 nt, Artificial Sequence; identical to SEQ ID NO: 164961
  derived and/or modified sequence opt4 from hemagglutinin__InfluenzaA__ALA08586

SEQ ID NO: 165582 - RNA, 1701 nt, Artificial Sequence; identical to SEQ ID NO: 165577
  derived and/or modified sequence opt4 from hemagglutinin__InfluenzaA__ALA08587

SEQ ID NO: 165583 - RNA, 1701 nt, Artificial Sequence; identical to SEQ ID NO: 164961
  derived and/or modified sequence opt4 from hemagglutinin__InfluenzaA__ALA08588

SEQ ID NO: 165584 - RNA, 1701 nt, Artificial Sequence; identical to SEQ ID NO: 164961
  derived and/or modified sequence opt4 from hemagglutinin__InfluenzaA__ALA08589

SEQ ID NO: 165585 - RNA, 1701 nt, Artificial Sequence; identical to SEQ ID NO: 165577
  derived and/or modified sequence opt4 from hemagglutinin__InfluenzaA__ALA08590

SEQ ID NO: 165586 - RNA, 1701 nt, Artificial Sequence; identical to SEQ ID NO: 164961
  derived and/or modified sequence opt4 from hemagglutinin__InfluenzaA__ALA08591

SEQ ID NO: 165587 - RNA, 1701 nt, Artificial Sequence; identical to SEQ ID NO: 165518
  derived and/or modified sequence opt4 from hemagglutinin__InfluenzaA__ALA08592

SEQ ID NO: 165588 - RNA, 1701 nt, Artificial Sequence
  derived and/or modified sequence opt4 from hemagglutinin__InfluenzaA__ALA08594
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggcccugcugggcuucaucaugugggccugccagaagggcaacaucagaugcaacaucugcaucuga

SEQ ID NO: 165589 - RNA, 1701 nt, Artificial Sequence; identical to SEQ ID NO: 164961
  derived and/or modified sequence opt4 from hemagglutinin__InfluenzaA__ALA08595

SEQ ID NO: 165590 - RNA, 1701 nt, Artificial Sequence; identical to SEQ ID NO: 164961
  derived and/or modified sequence opt4 from hemagglutinin__InfluenzaA__ALA08596

SEQ ID NO: 165591 - RNA, 1701 nt, Artificial Sequence
  derived and/or modified sequence opt4 from hemagglutinin__InfluenzaA__ALA08597
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaacggcaacaucagaugcaacaucugcaucuga

SEQ ID NO: 165592 - RNA, 1701 nt, Artificial Sequence
  derived and/or modified sequence opt4 from hemagglutinin__InfluenzaA__ALA08598
augaagaccaucaucgccagcagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165593 - RNA, 1701 nt, Artificial Sequence; identical to SEQ ID NO: 164961
  derived and/or modified sequence opt4 from hemagglutinin__InfluenzaA__ALA08599

SEQ ID NO: 165594 - RNA, 1701 nt, Artificial Sequence
  derived and/or modified sequence opt4 from hemagglutinin__InfluenzaA__ALA08600
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacagauaccccgcccugaacgugaccaugcccaacaacgagcaguucgacaagcuguacaucuggggcgugcaccaccccggcaccgacaaggaccagaucagccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165595 - RNA, 1701 nt, Artificial Sequence; identical to SEQ ID NO: 164961
  derived and/or modified sequence opt4 from hemagglutinin__InfluenzaA__ALA08601

SEQ ID NO: 165596 - RNA, 1701 nt, Artificial Sequence
  derived and/or modified sequence opt4 from hemagglutinin__InfluenzaA__ALA08602
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucagccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165597 - RNA, 1701 nt, Artificial Sequence
  derived and/or modified sequence opt4 from hemagglutinin__InfluenzaA__ALA08603
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaucuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165598 - RNA, 1701 nt, Artificial Sequence; identical to SEQ ID NO: 164961
  derived and/or modified sequence opt4 from hemagglutinin__InfluenzaA__ALA08605

SEQ ID NO: 165599 - RNA, 1701 nt, Artificial Sequence; identical to SEQ ID NO: 164961
  derived and/or modified sequence opt4 from hemagglutinin__InfluenzaA__ALA08606

SEQ ID NO: 165600 - RNA, 1701 nt, Artificial Sequence; identical to SEQ ID NO: 165576
  derived and/or modified sequence opt4 from hemagglutinin__InfluenzaA__ALA08607

SEQ ID NO: 165601 - RNA, 1701 nt, Artificial Sequence
  derived and/or modified sequence opt4 from hemagglutinin__InfluenzaA__ALA08609
augaagaccaucaucgcccugggcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccacaagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggacaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165602 - RNA, 1701 nt, Artificial Sequence; identical to SEQ ID NO: 165518
  derived and/or modified sequence opt4 from hemagglutinin__InfluenzaA__ALA08610

SEQ ID NO: 165603 - RNA, 1701 nt, Artificial Sequence
  derived and/or modified sequence opt4 from hemagglutinin__InfluenzaA__ALA08611
augaagaucaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccacagaauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165604 - RNA, 1701 nt, Artificial Sequence; identical to SEQ ID NO: 165576
  derived and/or modified sequence opt4 from hemagglutinin__InfluenzaA__ALA08612

SEQ ID NO: 165605 - RNA, 1701 nt, Artificial Sequence; identical to SEQ ID NO: 164961
  derived and/or modified sequence opt4 from hemagglutinin__InfluenzaA__ALA08614

SEQ ID NO: 165606 - RNA, 1701 nt, Artificial Sequence; identical to SEQ ID NO: 164961
  derived and/or modified sequence opt4 from hemagglutinin__InfluenzaA__ALA08615

SEQ ID NO: 165607 - RNA, 1701 nt, Artificial Sequence; identical to SEQ ID NO: 164961
  derived and/or modified sequence opt4 from hemagglutinin__InfluenzaA__ALA08616

SEQ ID NO: 165608 - RNA, 1701 nt, Artificial Sequence; identical to SEQ ID NO: 165501
  derived and/or modified sequence opt4 from hemagglutinin__InfluenzaA__ALA08617

SEQ ID NO: 165609 - RNA, 1701 nt, Artificial Sequence
  derived and/or modified sequence opt4 from hemagglutinin__InfluenzaA__ALA08619
augaagaccgugaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgagaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaucuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165610 - RNA, 1701 nt, Artificial Sequence; identical to SEQ ID NO: 165576
  derived and/or modified sequence opt4 from hemagglutinin__InfluenzaA__ALA08620

SEQ ID NO: 165611 - RNA, 1701 nt, Artificial Sequence; identical to SEQ ID NO: 165567
  derived and/or modified sequence opt4 from hemagglutinin__InfluenzaA__ALA08621

SEQ ID NO: 165612 - RNA, 1701 nt, Artificial Sequence
  derived and/or modified sequence opt4 from hemagglutinin__InfluenzaA__ALA08622
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165613 - RNA, 1701 nt, Artificial Sequence; identical to SEQ ID NO: 164961
  derived and/or modified sequence opt4 from hemagglutinin__InfluenzaA__ALA08623

SEQ ID NO: 165614 - RNA, 1701 nt, Artificial Sequence; identical to SEQ ID NO: 165567
  derived and/or modified sequence opt4 from hemagglutinin__InfluenzaA__ALA08624

SEQ ID NO: 165615 - RNA, 1701 nt, Artificial Sequence; identical to SEQ ID NO: 164961
  derived and/or modified sequence opt4 from hemagglutinin__InfluenzaA__ALA08625

SEQ ID NO: 165616 - RNA, 1701 nt, Artificial Sequence; identical to SEQ ID NO: 164961
  derived and/or modified sequence opt4 from hemagglutinin__InfluenzaA__ALA08626

SEQ ID NO: 165617 - RNA, 1701 nt, Artificial Sequence; identical to SEQ ID NO: 164961
  derived and/or modified sequence opt4 from hemagglutinin__InfluenzaA__ALA08627

SEQ ID NO: 165618 - RNA, 1701 nt, Artificial Sequence; identical to SEQ ID NO: 165505
  derived and/or modified sequence opt4 from hemagglutinin__InfluenzaA__ALA08629

SEQ ID NO: 165619 - RNA, 1701 nt, Artificial Sequence
  derived and/or modified sequence opt4 from hemagglutinin__InfluenzaA__ALA08630
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165620 - RNA, 1701 nt, Artificial Sequence
  derived and/or modified sequence opt4 from hemagglutinin__InfluenzaA__ALA08631
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaaggagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165621 - RNA, 1701 nt, Artificial Sequence
  derived and/or modified sequence opt4 from hemagglutinin__InfluenzaA__ALA08632
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagggcagccagcaggccgugauccccaacgugggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165622 - RNA, 1701 nt, Artificial Sequence; identical to SEQ ID NO: 165518
  derived and/or modified sequence opt4 from hemagglutinin__InfluenzaA__ALA08634

SEQ ID NO: 165623 - RNA, 1701 nt, Artificial Sequence; identical to SEQ ID NO: 164961
  derived and/or modified sequence opt4 from hemagglutinin__InfluenzaA__ALA08635

SEQ ID NO: 165624 - RNA, 1701 nt, Artificial Sequence
  derived and/or modified sequence opt4 from hemagglutinin__InfluenzaA__ALA08636
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcauccaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165625 - RNA, 1701 nt, Artificial Sequence; identical to SEQ ID NO: 165518
  derived and/or modified sequence opt4 from hemagglutinin__InfluenzaA__ALA08637

SEQ ID NO: 165626 - RNA, 1701 nt, Artificial Sequence
  derived and/or modified sequence opt4 from hemagglutinin__InfluenzaA__ALA08638
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165627 - RNA, 1701 nt, Artificial Sequence; identical to SEQ ID NO: 165518
  derived and/or modified sequence opt4 from hemagglutinin__InfluenzaA__ALA08639

SEQ ID NO: 165628 - RNA, 1701 nt, Artificial Sequence; identical to SEQ ID NO: 165518
  derived and/or modified sequence opt4 from hemagglutinin__InfluenzaA__ALA08640

SEQ ID NO: 165629 - RNA, 1701 nt, Artificial Sequence; identical to SEQ ID NO: 165518
  derived and/or modified sequence opt4 from hemagglutinin__InfluenzaA__ALA08641

SEQ ID NO: 165630 - RNA, 1701 nt, Artificial Sequence; identical to SEQ ID NO: 165518
  derived and/or modified sequence opt4 from hemagglutinin__InfluenzaA__ALA08642

SEQ ID NO: 165631 - RNA, 1701 nt, Artificial Sequence; identical to SEQ ID NO: 165518
  derived and/or modified sequence opt4 from hemagglutinin__InfluenzaA__ALA08643

SEQ ID NO: 165632 - RNA, 1701 nt, Artificial Sequence; identical to SEQ ID NO: 164961
  derived and/or modified sequence opt4 from hemagglutinin__InfluenzaA__ALA08644

SEQ ID NO: 165633 - RNA, 1701 nt, Artificial Sequence
  derived and/or modified sequence opt4 from hemagglutinin__InfluenzaA__ALA08645
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgacaucuggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165634 - RNA, 1701 nt, Artificial Sequence; identical to SEQ ID NO: 164961
  derived and/or modified sequence opt4 from hemagglutinin__InfluenzaA__ALA08646

SEQ ID NO: 165635 - RNA, 1701 nt, Artificial Sequence; identical to SEQ ID NO: 164961
  derived and/or modified sequence opt4 from hemagglutinin__InfluenzaA__ALA08647

SEQ ID NO: 165636 - RNA, 1701 nt, Artificial Sequence; identical to SEQ ID NO: 165518
  derived and/or modified sequence opt4 from hemagglutinin__InfluenzaA__ALA08648

SEQ ID NO: 165637 - RNA, 1701 nt, Artificial Sequence
  derived and/or modified sequence opt4 from hemagglutinin__InfluenzaA__ALA08650
augaagaccaucaucgcccugagcuacauccugugccugguguucgcccagaagauccccggcaacgacaacagcaccgccacccugugccugggccaccacgccgugcccaacggcaccaucgugaagaccaucaccaacgagagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165638 - RNA, 1701 nt, Artificial Sequence; identical to SEQ ID NO: 165518
  derived and/or modified sequence opt4 from hemagglutinin__InfluenzaA__ALA08652

SEQ ID NO: 165639 - RNA, 1701 nt, Artificial Sequence; identical to SEQ ID NO: 164961
  derived and/or modified sequence opt4 from hemagglutinin__InfluenzaA__ALA08653

SEQ ID NO: 165640 - RNA, 1701 nt, Artificial Sequence
  derived and/or modified sequence opt4 from hemagglutinin__InfluenzaA__ALA08654
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaagagcugcuuccugcugugcguggcccugcugggcuucaucaugugggccugccagaagggcaacaucagaugcaacaucugcaucuga

SEQ ID NO: 165641 - RNA, 1701 nt, Artificial Sequence; identical to SEQ ID NO: 165518
  derived and/or modified sequence opt4 from hemagglutinin__InfluenzaA__ALA08655

SEQ ID NO: 165642 - RNA, 1701 nt, Artificial Sequence; identical to SEQ ID NO: 165518
  derived and/or modified sequence opt4 from hemagglutinin__InfluenzaA__ALA08656

SEQ ID NO: 165643 - RNA, 1701 nt, Artificial Sequence
  derived and/or modified sequence opt4 from hemagglutinin__InfluenzaA__ALA08657
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165644 - RNA, 1701 nt, Artificial Sequence; identical to SEQ ID NO: 165518
  derived and/or modified sequence opt4 from hemagglutinin__InfluenzaA__ALA08658

SEQ ID NO: 165645 - RNA, 1701 nt, Artificial Sequence; identical to SEQ ID NO: 165505
  derived and/or modified sequence opt4 from hemagglutinin__InfluenzaA__ALA08659

SEQ ID NO: 165646 - RNA, 1701 nt, Artificial Sequence
  derived and/or modified sequence opt4 from hemagglutinin__InfluenzaA__ALA08660
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacggcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165647 - RNA, 1701 nt, Artificial Sequence
  derived and/or modified sequence opt4 from hemagglutinin__InfluenzaA__ALA08662
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagauccugagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacagcaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165648 - RNA, 1701 nt, Artificial Sequence; identical to SEQ ID NO: 165619
  derived and/or modified sequence opt4 from hemagglutinin__InfluenzaA__ALA08663

SEQ ID NO: 165649 - RNA, 1701 nt, Artificial Sequence; identical to SEQ ID NO: 165647
  derived and/or modified sequence opt4 from hemagglutinin__InfluenzaA__ALA08665

SEQ ID NO: 165650 - RNA, 1701 nt, Artificial Sequence
  derived and/or modified sequence opt4 from hemagglutinin__InfluenzaA__ALA08666
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggcccugcugggcuucaucaugugggccugccagaagggcaacaucagaugcaacaucugcaucuga

SEQ ID NO: 165651 - RNA, 1701 nt, Artificial Sequence
  derived and/or modified sequence opt4 from hemagglutinin__InfluenzaA__ALA08667
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165652 - RNA, 1701 nt, Artificial Sequence
  derived and/or modified sequence opt4 from hemagglutinin__InfluenzaA__ALA08668
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggccaucaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165653 - RNA, 1701 nt, Artificial Sequence; identical to SEQ ID NO: 165619
  derived and/or modified sequence opt4 from hemagglutinin__InfluenzaA__ALA08669

SEQ ID NO: 165654 - RNA, 1701 nt, Artificial Sequence; identical to SEQ ID NO: 165512
  derived and/or modified sequence opt4 from hemagglutinin__InfluenzaA__ALA08670

SEQ ID NO: 165655 - RNA, 1701 nt, Artificial Sequence; identical to SEQ ID NO: 165619
  derived and/or modified sequence opt4 from hemagglutinin__InfluenzaA__ALA08671

SEQ ID NO: 165656 - RNA, 1701 nt, Artificial Sequence; identical to SEQ ID NO: 165619
  derived and/or modified sequence opt4 from hemagglutinin__InfluenzaA__ALA08672

SEQ ID NO: 165657 - RNA, 1701 nt, Artificial Sequence; identical to SEQ ID NO: 165512
  derived and/or modified sequence opt4 from hemagglutinin__InfluenzaA__ALA08673

SEQ ID NO: 165658 - RNA, 1701 nt, Artificial Sequence; identical to SEQ ID NO: 165619
  derived and/or modified sequence opt4 from hemagglutinin__InfluenzaA__ALA08674

SEQ ID NO: 165659 - RNA, 1701 nt, Artificial Sequence; identical to SEQ ID NO: 164961
  derived and/or modified sequence opt4 from hemagglutinin__InfluenzaA__ALA08675

SEQ ID NO: 165660 - RNA, 1701 nt, Artificial Sequence; identical to SEQ ID NO: 165619
  derived and/or modified sequence opt4 from hemagglutinin__InfluenzaA__ALA08676

SEQ ID NO: 165661 - RNA, 1701 nt, Artificial Sequence; identical to SEQ ID NO: 165619
  derived and/or modified sequence opt4 from hemagglutinin__InfluenzaA__ALA08677

SEQ ID NO: 165662 - RNA, 1701 nt, Artificial Sequence; identical to SEQ ID NO: 165619
  derived and/or modified sequence opt4 from hemagglutinin__InfluenzaA__ALA08678

SEQ ID NO: 165663 - RNA, 1701 nt, Artificial Sequence; identical to SEQ ID NO: 165619
  derived and/or modified sequence opt4 from hemagglutinin__InfluenzaA__ALA08679

SEQ ID NO: 165664 - RNA, 1701 nt, Artificial Sequence; identical to SEQ ID NO: 165619
  derived and/or modified sequence opt4 from hemagglutinin__InfluenzaA__ALA08680

SEQ ID NO: 165665 - RNA, 1701 nt, Artificial Sequence; identical to SEQ ID NO: 165518
  derived and/or modified sequence opt4 from hemagglutinin__InfluenzaA__ALA08681

SEQ ID NO: 165666 - RNA, 1701 nt, Artificial Sequence; identical to SEQ ID NO: 165597
  derived and/or modified sequence opt4 from hemagglutinin__InfluenzaA__ALA08682

SEQ ID NO: 165667 - RNA, 1701 nt, Artificial Sequence; identical to SEQ ID NO: 165518
  derived and/or modified sequence opt4 from hemagglutinin__InfluenzaA__ALA08683

SEQ ID NO: 165668 - RNA, 1701 nt, Artificial Sequence
  derived and/or modified sequence opt4 from hemagglutinin__InfluenzaA__ALA08684
augaagaccaucaucgcccugagccacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcaucgagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165669 - RNA, 1701 nt, Artificial Sequence; identical to SEQ ID NO: 164961
  derived and/or modified sequence opt4 from hemagglutinin__InfluenzaA__ALA08686

SEQ ID NO: 165670 - RNA, 1701 nt, Artificial Sequence
  derived and/or modified sequence opt4 from hemagglutinin__InfluenzaA__ALA08687
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165671 - RNA, 1701 nt, Artificial Sequence; identical to SEQ ID NO: 165612
  derived and/or modified sequence opt4 from hemagglutinin__InfluenzaA__ALA08688

SEQ ID NO: 165672 - RNA, 1701 nt, Artificial Sequence; identical to SEQ ID NO: 164961
  derived and/or modified sequence opt4 from hemagglutinin__InfluenzaA__ALE31612

SEQ ID NO: 165673 - RNA, 1701 nt, Artificial Sequence
  derived and/or modified sequence opt4 from hemagglutinin__InfluenzaA__ALE31613
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucagcagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugccugcugcugugcguggcccugcugggcuucaucaugugggccugccagaagggcaacaucagaugcaacaucugcaucuga

SEQ ID NO: 165674 - RNA, 1701 nt, Artificial Sequence
  derived and/or modified sequence opt4 from hemagglutinin__InfluenzaA__ALE31614
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcaagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165675 - RNA, 1701 nt, Artificial Sequence
  derived and/or modified sequence opt4 from hemagglutinin__InfluenzaA__ALE31615
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165676 - RNA, 1701 nt, Artificial Sequence; identical to SEQ ID NO: 164961
  derived and/or modified sequence opt4 from hemagglutinin__InfluenzaA__ALE31616

SEQ ID NO: 165677 - RNA, 1701 nt, Artificial Sequence; identical to SEQ ID NO: 164961
  derived and/or modified sequence opt4 from hemagglutinin__InfluenzaA__ALE31617

SEQ ID NO: 165678 - RNA, 1701 nt, Artificial Sequence; identical to SEQ ID NO: 164961
  derived and/or modified sequence opt4 from hemagglutinin__InfluenzaA__ALE31618

SEQ ID NO: 165679 - RNA, 1701 nt, Artificial Sequence; identical to SEQ ID NO: 165619
  derived and/or modified sequence opt4 from hemagglutinin__InfluenzaA__ALE31619

SEQ ID NO: 165680 - RNA, 1701 nt, Artificial Sequence; identical to SEQ ID NO: 164961
  derived and/or modified sequence opt4 from hemagglutinin__InfluenzaA__ALE31620

SEQ ID NO: 165681 - RNA, 1701 nt, Artificial Sequence
  derived and/or modified sequence opt4 from hemagglutinin__InfluenzaA__ALE31622
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgugcccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165682 - RNA, 1701 nt, Artificial Sequence; identical to SEQ ID NO: 164961
  derived and/or modified sequence opt4 from hemagglutinin__InfluenzaA__ALE31623

SEQ ID NO: 165683 - RNA, 1701 nt, Artificial Sequence; identical to SEQ ID NO: 164961
  derived and/or modified sequence opt4 from hemagglutinin__InfluenzaA__ALE31625

SEQ ID NO: 165684 - RNA, 1701 nt, Artificial Sequence; identical to SEQ ID NO: 164961
  derived and/or modified sequence opt4 from hemagglutinin__InfluenzaA__ALE31626

SEQ ID NO: 165685 - RNA, 1701 nt, Artificial Sequence; identical to SEQ ID NO: 164961
  derived and/or modified sequence opt4 from hemagglutinin__InfluenzaA__ALE31627

SEQ ID NO: 165686 - RNA, 1701 nt, Artificial Sequence; identical to SEQ ID NO: 164961
  derived and/or modified sequence opt4 from hemagglutinin__InfluenzaA__ALE31628

SEQ ID NO: 165687 - RNA, 1701 nt, Artificial Sequence; identical to SEQ ID NO: 164961
  derived and/or modified sequence opt4 from hemagglutinin__InfluenzaA__ALE31629

SEQ ID NO: 165688 - RNA, 1701 nt, Artificial Sequence; identical to SEQ ID NO: 164961
  derived and/or modified sequence opt4 from hemagglutinin__InfluenzaA__ALE31632

SEQ ID NO: 165689 - RNA, 1701 nt, Artificial Sequence
  derived and/or modified sequence opt4 from hemagglutinin__InfluenzaA__ALE31634
augaagaccaucaucgcccugagcuacauccugugccuggugcuggcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165690 - RNA, 1701 nt, Artificial Sequence; identical to SEQ ID NO: 164961
  derived and/or modified sequence opt4 from hemagglutinin__InfluenzaA__ALE31635

SEQ ID NO: 165691 - RNA, 1701 nt, Artificial Sequence; identical to SEQ ID NO: 164961
  derived and/or modified sequence opt4 from hemagglutinin__InfluenzaA__ALE31636

SEQ ID NO: 165692 - RNA, 1701 nt, Artificial Sequence
  derived and/or modified sequence opt4 from hemagglutinin__InfluenzaA__ALE31638
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacggcaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165693 - RNA, 1701 nt, Artificial Sequence; identical to SEQ ID NO: 164961
  derived and/or modified sequence opt4 from hemagglutinin__InfluenzaA__ALE31639

SEQ ID NO: 165694 - RNA, 1701 nt, Artificial Sequence; identical to SEQ ID NO: 165512
  derived and/or modified sequence opt4 from hemagglutinin__InfluenzaA__ALE31640

SEQ ID NO: 165695 - RNA, 1701 nt, Artificial Sequence; identical to SEQ ID NO: 165518
  derived and/or modified sequence opt4 from hemagglutinin__InfluenzaA__ALE31641

SEQ ID NO: 165696 - RNA, 1701 nt, Artificial Sequence; identical to SEQ ID NO: 165518
  derived and/or modified sequence opt4 from hemagglutinin__InfluenzaA__ALE31642

SEQ ID NO: 165697 - RNA, 1701 nt, Artificial Sequence
  derived and/or modified sequence opt4 from hemagglutinin__InfluenzaA__ALE31643
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaccgccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165698 - RNA, 1701 nt, Artificial Sequence; identical to SEQ ID NO: 164961
  derived and/or modified sequence opt4 from hemagglutinin__InfluenzaA__ALE31644

SEQ ID NO: 165699 - RNA, 1701 nt, Artificial Sequence; identical to SEQ ID NO: 164961
  derived and/or modified sequence opt4 from hemagglutinin__InfluenzaA__ALE31645

SEQ ID NO: 165700 - RNA, 1701 nt, Artificial Sequence; identical to SEQ ID NO: 164961
  derived and/or modified sequence opt4 from hemagglutinin__InfluenzaA__ALE31646

SEQ ID NO: 165701 - RNA, 1701 nt, Artificial Sequence; identical to SEQ ID NO: 165518
  derived and/or modified sequence opt4 from hemagglutinin__InfluenzaA__ALE31647

SEQ ID NO: 165702 - RNA, 1701 nt, Artificial Sequence
  derived and/or modified sequence opt4 from hemagglutinin__InfluenzaA__ALE31648
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagcccagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaccgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165703 - RNA, 1701 nt, Artificial Sequence; identical to SEQ ID NO: 164961
  derived and/or modified sequence opt4 from hemagglutinin__InfluenzaA__ALE31649

SEQ ID NO: 165704 - RNA, 1701 nt, Artificial Sequence; identical to SEQ ID NO: 165518
  derived and/or modified sequence opt4 from hemagglutinin__InfluenzaA__ALE31650

SEQ ID NO: 165705 - RNA, 1701 nt, Artificial Sequence
  derived and/or modified sequence opt4 from hemagglutinin__InfluenzaA__ALE31652
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucagccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165706 - RNA, 1701 nt, Artificial Sequence; identical to SEQ ID NO: 165612
  derived and/or modified sequence opt4 from hemagglutinin__InfluenzaA__ALE31653

SEQ ID NO: 165707 - RNA, 1701 nt, Artificial Sequence; identical to SEQ ID NO: 164961
  derived and/or modified sequence opt4 from hemagglutinin__InfluenzaA__ALE31654

SEQ ID NO: 165708 - RNA, 1701 nt, Artificial Sequence; identical to SEQ ID NO: 164961
  derived and/or modified sequence opt4 from hemagglutinin__InfluenzaA__ALE31655

SEQ ID NO: 165709 - RNA, 1701 nt, Artificial Sequence
  derived and/or modified sequence opt4 from hemagglutinin__InfluenzaA__ALE31656
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggacaucuucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165710 - RNA, 1701 nt, Artificial Sequence
  derived and/or modified sequence opt4 from hemagglutinin__InfluenzaA__ALE31657
augaagaccaucaucgcccugagcuacauccugugccuggugagcgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165711 - RNA, 1701 nt, Artificial Sequence; identical to SEQ ID NO: 164961
  derived and/or modified sequence opt4 from hemagglutinin__InfluenzaA__ALE31658

SEQ ID NO: 165712 - RNA, 1701 nt, Artificial Sequence; identical to SEQ ID NO: 165576
  derived and/or modified sequence opt4 from hemagglutinin__InfluenzaA__ALE31659

SEQ ID NO: 165713 - RNA, 1701 nt, Artificial Sequence; identical to SEQ ID NO: 165505
  derived and/or modified sequence opt4 from hemagglutinin__InfluenzaA__ALE31660

SEQ ID NO: 165714 - RNA, 1701 nt, Artificial Sequence
  derived and/or modified sequence opt4 from hemagglutinin__InfluenzaA__ALE31661
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagaagagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165715 - RNA, 1701 nt, Artificial Sequence
  derived and/or modified sequence opt4 from hemagglutinin__InfluenzaA__ALE31662
augaagaccaucaucgcccugagcuacauccugugccugguguucgcccagaagauccccggcaacgacaacagcaccgccacccugugccugggccaccacgccgugcccaacggcaccaucgugaagaccaucgccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugccugcugcugugcguggcccugcugggcuucaucaugugggccugccagaagggcaacaucagaugcaacaucugcaucuga

SEQ ID NO: 165716 - RNA, 1701 nt, Artificial Sequence; identical to SEQ ID NO: 164947
  derived and/or modified sequence opt4 from hemagglutinin__InfluenzaA__ALE31663

SEQ ID NO: 165717 - RNA, 1701 nt, Artificial Sequence
  derived and/or modified sequence opt4 from hemagglutinin__InfluenzaA__ALE31666
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaaguacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165718 - RNA, 1701 nt, Artificial Sequence
  derived and/or modified sequence opt4 from hemagglutinin__InfluenzaA__ALE31667
augaagaccaucaucgcccugagcuacauccugugccugguguucgcccagaagauccccggcaacgacaacagcaccgccacccugugccugggccaccacgccgugcugaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165719 - RNA, 1701 nt, Artificial Sequence; identical to SEQ ID NO: 164961
  derived and/or modified sequence opt4 from hemagglutinin__InfluenzaA__ALE31668

SEQ ID NO: 165720 - RNA, 1701 nt, Artificial Sequence; identical to SEQ ID NO: 164961
  derived and/or modified sequence opt4 from hemagglutinin__InfluenzaA__ALE31669

SEQ ID NO: 165721 - RNA, 1701 nt, Artificial Sequence
  derived and/or modified sequence opt4 from hemagglutinin__InfluenzaA__ALE31670
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagaugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165722 - RNA, 1701 nt, Artificial Sequence; identical to SEQ ID NO: 164961
  derived and/or modified sequence opt4 from hemagglutinin__InfluenzaA__ALE31671

SEQ ID NO: 165723 - RNA, 1701 nt, Artificial Sequence; identical to SEQ ID NO: 164961
  derived and/or modified sequence opt4 from hemagglutinin__InfluenzaA__ALE31672

SEQ ID NO: 165724 - RNA, 1701 nt, Artificial Sequence; identical to SEQ ID NO: 165518
  derived and/or modified sequence opt4 from hemagglutinin__InfluenzaA__ALE31673

SEQ ID NO: 165725 - RNA, 1701 nt, Artificial Sequence
  derived and/or modified sequence opt4 from hemagglutinin__InfluenzaA__ALE31674
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccacagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165726 - RNA, 1701 nt, Artificial Sequence
  derived and/or modified sequence opt4 from hemagglutinin__InfluenzaA__ALE31675
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165727 - RNA, 1701 nt, Artificial Sequence
  derived and/or modified sequence opt4 from hemagglutinin__InfluenzaA__ALE31676
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccaagaucagagacauccccagcagaaucagcaucuacuggaccaucgugaagcccggcgacauccugcugaucaacagcaccggcaaccugaucgcccccagaggcuacuucaagauccugagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacagcaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165728 - RNA, 1701 nt, Artificial Sequence; identical to SEQ ID NO: 165619
  derived and/or modified sequence opt4 from hemagglutinin__InfluenzaA__ALE31677

SEQ ID NO: 165729 - RNA, 1701 nt, Artificial Sequence; identical to SEQ ID NO: 164961
  derived and/or modified sequence opt4 from hemagglutinin__InfluenzaA__ALE31678

SEQ ID NO: 165730 - RNA, 1701 nt, Artificial Sequence; identical to SEQ ID NO: 164961
  derived and/or modified sequence opt4 from hemagglutinin__InfluenzaA__ALE31679

SEQ ID NO: 165731 - RNA, 1701 nt, Artificial Sequence; identical to SEQ ID NO: 165577
  derived and/or modified sequence opt4 from hemagglutinin__InfluenzaA__ALE31680

SEQ ID NO: 165732 - RNA, 1701 nt, Artificial Sequence; identical to SEQ ID NO: 165576
  derived and/or modified sequence opt4 from hemagglutinin__InfluenzaA__ALE31681

SEQ ID NO: 165733 - RNA, 1701 nt, Artificial Sequence; identical to SEQ ID NO: 164961
  derived and/or modified sequence opt4 from hemagglutinin__InfluenzaA__ALE31682

SEQ ID NO: 165734 - RNA, 1701 nt, Artificial Sequence; identical to SEQ ID NO: 164961
  derived and/or modified sequence opt4 from hemagglutinin__InfluenzaA__ALE31683

SEQ ID NO: 165735 - RNA, 1701 nt, Artificial Sequence; identical to SEQ ID NO: 164961
  derived and/or modified sequence opt4 from hemagglutinin__InfluenzaA__ALE31684

SEQ ID NO: 165736 - RNA, 1701 nt, Artificial Sequence; identical to SEQ ID NO: 164961
  derived and/or modified sequence opt4 from hemagglutinin__InfluenzaA__ALE31685

SEQ ID NO: 165737 - RNA, 1701 nt, Artificial Sequence; identical to SEQ ID NO: 164961
  derived and/or modified sequence opt4 from hemagglutinin__InfluenzaA__ALE31686

SEQ ID NO: 165738 - RNA, 1701 nt, Artificial Sequence
  derived and/or modified sequence opt4 from hemagglutinin__InfluenzaA__ALE31687
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucgagagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165739 - RNA, 1701 nt, Artificial Sequence
  derived and/or modified sequence opt4 from hemagglutinin__InfluenzaA__ALE31688
augaagaccaccaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165740 - RNA, 1701 nt, Artificial Sequence; identical to SEQ ID NO: 164961
  derived and/or modified sequence opt4 from hemagglutinin__InfluenzaA__ALE31689

SEQ ID NO: 165741 - RNA, 1701 nt, Artificial Sequence
  derived and/or modified sequence opt4 from hemagglutinin__InfluenzaA__ALE31690
augaagaccaucaucgcccugagcugcauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165742 - RNA, 1701 nt, Artificial Sequence; identical to SEQ ID NO: 162514
  derived and/or modified sequence opt4 from hemagglutinin__InfluenzaA__ALE31691

SEQ ID NO: 165743 - RNA, 1701 nt, Artificial Sequence
  derived and/or modified sequence opt4 from hemagglutinin__InfluenzaA__ALE31692
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcuacagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165744 - RNA, 1701 nt, Artificial Sequence; identical to SEQ ID NO: 165743
  derived and/or modified sequence opt4 from hemagglutinin__InfluenzaA__ALE31693

SEQ ID NO: 165745 - RNA, 1701 nt, Artificial Sequence; identical to SEQ ID NO: 164961
  derived and/or modified sequence opt4 from hemagglutinin__InfluenzaA__ALE31694

SEQ ID NO: 165746 - RNA, 1701 nt, Artificial Sequence; identical to SEQ ID NO: 165743
  derived and/or modified sequence opt4 from hemagglutinin__InfluenzaA__ALE31695

SEQ ID NO: 165747 - RNA, 1701 nt, Artificial Sequence; identical to SEQ ID NO: 165619
  derived and/or modified sequence opt4 from hemagglutinin__InfluenzaA__ALE31696

SEQ ID NO: 165748 - RNA, 1701 nt, Artificial Sequence; identical to SEQ ID NO: 165743
  derived and/or modified sequence opt4 from hemagglutinin__InfluenzaA__ALE31697

SEQ ID NO: 165749 - RNA, 1701 nt, Artificial Sequence
  derived and/or modified sequence opt4 from hemagglutinin__InfluenzaA__ALE31698
augaagaccaucaucgcccugagcuacauccugugcaugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165750 - RNA, 1701 nt, Artificial Sequence
  derived and/or modified sequence opt4 from hemagglutinin__InfluenzaA__ALE31699
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccaacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacgccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165751 - RNA, 1701 nt, Artificial Sequence; identical to SEQ ID NO: 164961
  derived and/or modified sequence opt4 from hemagglutinin__InfluenzaA__ALE31700

SEQ ID NO: 165752 - RNA, 1701 nt, Artificial Sequence; identical to SEQ ID NO: 164961
  derived and/or modified sequence opt4 from hemagglutinin__InfluenzaA__ALE31701

SEQ ID NO: 165753 - RNA, 1701 nt, Artificial Sequence; identical to SEQ ID NO: 165518
  derived and/or modified sequence opt4 from hemagglutinin__InfluenzaA__ALE31702

SEQ ID NO: 165754 - RNA, 1701 nt, Artificial Sequence; identical to SEQ ID NO: 164961
  derived and/or modified sequence opt4 from hemagglutinin__InfluenzaA__ALE31703

SEQ ID NO: 165755 - RNA, 1701 nt, Artificial Sequence; identical to SEQ ID NO: 164961
  derived and/or modified sequence opt4 from hemagglutinin__InfluenzaA__ALE31704

SEQ ID NO: 165756 - RNA, 1701 nt, Artificial Sequence; identical to SEQ ID NO: 165518
  derived and/or modified sequence opt4 from hemagglutinin__InfluenzaA__ALE31705

SEQ ID NO: 165757 - RNA, 1701 nt, Artificial Sequence
  derived and/or modified sequence opt4 from hemagglutinin__InfluenzaA__ALE31706
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugccugcugcugugcguggcccugcugggcuucaucaugugggccugccagaagggcaacaucagaugcaacaucugcaucuga

SEQ ID NO: 165758 - RNA, 1701 nt, Artificial Sequence; identical to SEQ ID NO: 165647
  derived and/or modified sequence opt4 from hemagglutinin__InfluenzaA__ALE31707

SEQ ID NO: 165759 - RNA, 1701 nt, Artificial Sequence; identical to SEQ ID NO: 165647
  derived and/or modified sequence opt4 from hemagglutinin__InfluenzaA__ALE31708

SEQ ID NO: 165760 - RNA, 1701 nt, Artificial Sequence; identical to SEQ ID NO: 164947
  derived and/or modified sequence opt4 from hemagglutinin__InfluenzaA__ALE31709

SEQ ID NO: 165761 - RNA, 1701 nt, Artificial Sequence
  derived and/or modified sequence opt4 from hemagglutinin__InfluenzaA__ALE31710
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacugagaaucagagacauccccagcagaaucagcaucuacuggaccaucgugaagcccggcgacauccugcugaucaacagcaccggcaaccugaucgcccccagaggcuacuucaagauccugagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacagcaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165762 - RNA, 1701 nt, Artificial Sequence; identical to SEQ ID NO: 165647
  derived and/or modified sequence opt4 from hemagglutinin__InfluenzaA__ALE31711

SEQ ID NO: 165763 - RNA, 1701 nt, Artificial Sequence; identical to SEQ ID NO: 165505
  derived and/or modified sequence opt4 from hemagglutinin__InfluenzaA__ALE31712

SEQ ID NO: 165764 - RNA, 1701 nt, Artificial Sequence
  derived and/or modified sequence opt4 from hemagglutinin__InfluenzaA__ALE31713
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcauccaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacauccccgagaagcagaccaagggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 165765 - RNA, 1701 nt, Artificial Sequence; identical to SEQ ID NO: 165619
  derived and/or modified sequence opt4 from hemagglutinin__InfluenzaA__ALE31714

SEQ ID NO: 165766 - RNA, 1701 nt, Artificial Sequence; identical to SEQ ID NO: 165619
  derived and/or modified sequence opt4 from hemagglutinin__InfluenzaA__ALE31715

SEQ ID NO: 165767 - RNA, 1701 nt, Artificial Sequence; identical to SEQ ID NO: 165647
  derived and/or modified sequence opt4 from hemagglutinin__InfluenzaA__ALE31716

SEQ ID NO: 165768 - RNA, 1701 nt, Artificial Sequence
  derived and/or modified sequence opt4 from hemagglutinin__InfluenzaA__ALE31717
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagaccagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaccaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165769 - RNA, 1701 nt, Artificial Sequence; identical to SEQ ID NO: 165619
  derived and/or modified sequence opt4 from hemagglutinin__InfluenzaA__ALE31718

SEQ ID NO: 165770 - RNA, 1701 nt, Artificial Sequence
  derived and/or modified sequence opt4 from hemagglutinin__InfluenzaA__ALE31719
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacauccccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165771 - RNA, 1701 nt, Artificial Sequence; identical to SEQ ID NO: 165505
  derived and/or modified sequence opt4 from hemagglutinin__InfluenzaA__ALE31720

SEQ ID NO: 165772 - RNA, 1701 nt, Artificial Sequence; identical to SEQ ID NO: 165518
  derived and/or modified sequence opt4 from hemagglutinin__InfluenzaA__ALE31721

SEQ ID NO: 165773 - RNA, 1701 nt, Artificial Sequence; identical to SEQ ID NO: 165741
  derived and/or modified sequence opt4 from hemagglutinin__InfluenzaA__ALE31722

SEQ ID NO: 165774 - RNA, 1701 nt, Artificial Sequence
  derived and/or modified sequence opt4 from hemagglutinin__InfluenzaA__ALE31723
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaccacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165775 - RNA, 1701 nt, Artificial Sequence; identical to SEQ ID NO: 164961
  derived and/or modified sequence opt4 from hemagglutinin__InfluenzaA__ALE31724

SEQ ID NO: 165776 - RNA, 1701 nt, Artificial Sequence; identical to SEQ ID NO: 164961
  derived and/or modified sequence opt4 from hemagglutinin__InfluenzaA__ALE31725

SEQ ID NO: 165777 - RNA, 1701 nt, Artificial Sequence; identical to SEQ ID NO: 164961
  derived and/or modified sequence opt4 from hemagglutinin__InfluenzaA__ALE31726

SEQ ID NO: 165778 - RNA, 1701 nt, Artificial Sequence; identical to SEQ ID NO: 164961
  derived and/or modified sequence opt4 from hemagglutinin__InfluenzaA__ALE31727

SEQ ID NO: 165779 - RNA, 1701 nt, Artificial Sequence
  derived and/or modified sequence opt4 from hemagglutinin__InfluenzaA__ALE31728
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccauccccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165780 - RNA, 1701 nt, Artificial Sequence
  derived and/or modified sequence opt4 from hemagglutinin__InfluenzaA__ALE31729
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagaucaucgacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165781 - RNA, 1701 nt, Artificial Sequence; identical to SEQ ID NO: 164961
  derived and/or modified sequence opt4 from hemagglutinin__InfluenzaA__ALE31730

SEQ ID NO: 165782 - RNA, 1701 nt, Artificial Sequence
  derived and/or modified sequence opt4 from hemagglutinin__InfluenzaA__ALE31731
augaagaccaucaucgcccugagcuacauccugugccagguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165783 - RNA, 1701 nt, Artificial Sequence; identical to SEQ ID NO: 165619
  derived and/or modified sequence opt4 from hemagglutinin__InfluenzaA__ALE31732

SEQ ID NO: 165784 - RNA, 1701 nt, Artificial Sequence; identical to SEQ ID NO: 165619
  derived and/or modified sequence opt4 from hemagglutinin__InfluenzaA__ALE31733

SEQ ID NO: 165785 - RNA, 1701 nt, Artificial Sequence
  derived and/or modified sequence opt4 from hemagglutinin__InfluenzaA__ALE31734
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaaguacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcuucagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165786 - RNA, 1701 nt, Artificial Sequence; identical to SEQ ID NO: 165619
  derived and/or modified sequence opt4 from hemagglutinin__InfluenzaA__ALE31735

SEQ ID NO: 165787 - RNA, 1701 nt, Artificial Sequence; identical to SEQ ID NO: 165518
  derived and/or modified sequence opt4 from hemagglutinin__InfluenzaA__ALE31736

SEQ ID NO: 165788 - RNA, 1701 nt, Artificial Sequence; identical to SEQ ID NO: 165518
  derived and/or modified sequence opt4 from hemagglutinin__InfluenzaA__ALE31737

SEQ ID NO: 165789 - RNA, 1701 nt, Artificial Sequence
  derived and/or modified sequence opt4 from hemagglutinin__InfluenzaA__ALE31738
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165790 - RNA, 1701 nt, Artificial Sequence; identical to SEQ ID NO: 164961
  derived and/or modified sequence opt4 from hemagglutinin__InfluenzaA__ALE31739

SEQ ID NO: 165791 - RNA, 1701 nt, Artificial Sequence
  derived and/or modified sequence opt4 from hemagglutinin__InfluenzaA__ALE31741
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucagcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165792 - RNA, 1701 nt, Artificial Sequence
  derived and/or modified sequence opt4 from hemagglutinin__InfluenzaA__ALE31742
augaagaccaucaucgcccugagcuacauccugugccugggcuucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagagugaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165793 - RNA, 1701 nt, Artificial Sequence; identical to SEQ ID NO: 165518
  derived and/or modified sequence opt4 from hemagglutinin__InfluenzaA__ALE31743

SEQ ID NO: 165794 - RNA, 1701 nt, Artificial Sequence; identical to SEQ ID NO: 164961
  derived and/or modified sequence opt4 from hemagglutinin__InfluenzaA__ALE31744

SEQ ID NO: 165795 - RNA, 1701 nt, Artificial Sequence
  derived and/or modified sequence opt4 from hemagglutinin__InfluenzaA__ALE31745
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagagaugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacugagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaagagcgagugcaucacccccaacggcagcauccccaacgacaagcccuuccagaacgugaacaagaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165796 - RNA, 1701 nt, Artificial Sequence
  derived and/or modified sequence opt4 from hemagglutinin__InfluenzaA__ALE31747
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagagaugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagagugcaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165797 - RNA, 1701 nt, Artificial Sequence; identical to SEQ ID NO: 165518
  derived and/or modified sequence opt4 from hemagglutinin__InfluenzaA__ALE31748

SEQ ID NO: 165798 - RNA, 1701 nt, Artificial Sequence; identical to SEQ ID NO: 164961
  derived and/or modified sequence opt4 from hemagglutinin__InfluenzaA__ALE31749

SEQ ID NO: 165799 - RNA, 1701 nt, Artificial Sequence; identical to SEQ ID NO: 165505
  derived and/or modified sequence opt4 from hemagglutinin__InfluenzaA__ALE31750

SEQ ID NO: 165800 - RNA, 1701 nt, Artificial Sequence
  derived and/or modified sequence opt4 from hemagglutinin__InfluenzaA__ALE31751
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccuggacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165801 - RNA, 1701 nt, Artificial Sequence; identical to SEQ ID NO: 164961
  derived and/or modified sequence opt4 from hemagglutinin__InfluenzaA__ALE31752

SEQ ID NO: 165802 - RNA, 1701 nt, Artificial Sequence; identical to SEQ ID NO: 165505
  derived and/or modified sequence opt4 from hemagglutinin__InfluenzaA__ALE31753

SEQ ID NO: 165803 - RNA, 1701 nt, Artificial Sequence; identical to SEQ ID NO: 164961
  derived and/or modified sequence opt4 from hemagglutinin__InfluenzaA__ALE31754

SEQ ID NO: 165804 - RNA, 1701 nt, Artificial Sequence
  derived and/or modified sequence opt4 from hemagglutinin__InfluenzaA__ALE31755
augaagaccaucaucgcccugagcuacauccugugccugguguucgcccagaagcugcccgagaacgacaacagcaccgccacccugugccugggccaccacgccgugcccaacggcaccaucgugaagaccaucaccagcgaccagaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165805 - RNA, 1701 nt, Artificial Sequence; identical to SEQ ID NO: 165505
  derived and/or modified sequence opt4 from hemagglutinin__InfluenzaA__ALE31756

SEQ ID NO: 165806 - RNA, 1701 nt, Artificial Sequence; identical to SEQ ID NO: 164961
  derived and/or modified sequence opt4 from hemagglutinin__InfluenzaA__ALE31757

SEQ ID NO: 165807 - RNA, 1701 nt, Artificial Sequence
  derived and/or modified sequence opt4 from hemagglutinin__InfluenzaA__ALE31758
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugguggcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165808 - RNA, 1701 nt, Artificial Sequence
  derived and/or modified sequence opt4 from hemagglutinin__InfluenzaA__ALE31759
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagagaugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagagugaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaagagcgagugcaucacccccaacggcagcauccccaacaacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165809 - RNA, 1701 nt, Artificial Sequence
  derived and/or modified sequence opt4 from hemagglutinin__InfluenzaA__ALE31760
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcuacagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacgccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165810 - RNA, 1701 nt, Artificial Sequence; identical to SEQ ID NO: 165505
  derived and/or modified sequence opt4 from hemagglutinin__InfluenzaA__ALE31761

SEQ ID NO: 165811 - RNA, 1701 nt, Artificial Sequence; identical to SEQ ID NO: 164961
  derived and/or modified sequence opt4 from hemagglutinin__InfluenzaA__ALE31762

SEQ ID NO: 165812 - RNA, 1701 nt, Artificial Sequence; identical to SEQ ID NO: 165567
  derived and/or modified sequence opt4 from hemagglutinin__InfluenzaA__ALE31763

SEQ ID NO: 165813 - RNA, 1701 nt, Artificial Sequence; identical to SEQ ID NO: 165619
  derived and/or modified sequence opt4 from hemagglutinin__InfluenzaA__ALE31764

SEQ ID NO: 165814 - RNA, 1701 nt, Artificial Sequence; identical to SEQ ID NO: 164961
  derived and/or modified sequence opt4 from hemagglutinin__InfluenzaA__ALE31765

SEQ ID NO: 165815 - RNA, 1701 nt, Artificial Sequence
  derived and/or modified sequence opt4 from hemagglutinin__InfluenzaA__ALE31774
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagguguuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165816 - RNA, 1701 nt, Artificial Sequence
  derived and/or modified sequence opt4 from hemagglutinin__InfluenzaA__ALE31775
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgaguuccugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165817 - RNA, 1701 nt, Artificial Sequence
  derived and/or modified sequence opt4 from hemagglutinin__InfluenzaA__ALE31776
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgccagcaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165818 - RNA, 1701 nt, Artificial Sequence
  derived and/or modified sequence opt4 from hemagglutinin__InfluenzaA__ALE31777
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccguggugcccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165819 - RNA, 1701 nt, Artificial Sequence; identical to SEQ ID NO: 165567
  derived and/or modified sequence opt4 from hemagglutinin__InfluenzaA__ALE31778

SEQ ID NO: 165820 - RNA, 1701 nt, Artificial Sequence; identical to SEQ ID NO: 164961
  derived and/or modified sequence opt4 from hemagglutinin__InfluenzaA__ALE31779

SEQ ID NO: 165821 - RNA, 1701 nt, Artificial Sequence
  derived and/or modified sequence opt4 from hemagglutinin__InfluenzaA__ALE31780
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaaccgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165822 - RNA, 1701 nt, Artificial Sequence
  derived and/or modified sequence opt4 from hemagglutinin__InfluenzaA__ALE31781
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcggcagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcaagcugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165823 - RNA, 1701 nt, Artificial Sequence
  derived and/or modified sequence opt4 from hemagglutinin__InfluenzaA__ALE31782
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgugagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165824 - RNA, 1701 nt, Artificial Sequence
  derived and/or modified sequence opt4 from hemagglutinin__InfluenzaA__ALE31783
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccgugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165825 - RNA, 1701 nt, Artificial Sequence; identical to SEQ ID NO: 165577
  derived and/or modified sequence opt4 from hemagglutinin__InfluenzaA__ALE31784

SEQ ID NO: 165826 - RNA, 1701 nt, Artificial Sequence; identical to SEQ ID NO: 164961
  derived and/or modified sequence opt4 from hemagglutinin__InfluenzaA__ALE31785

SEQ ID NO: 165827 - RNA, 1701 nt, Artificial Sequence; identical to SEQ ID NO: 165567
  derived and/or modified sequence opt4 from hemagglutinin__InfluenzaA__ALE31786

SEQ ID NO: 165828 - RNA, 1701 nt, Artificial Sequence; identical to SEQ ID NO: 165619
  derived and/or modified sequence opt4 from hemagglutinin__InfluenzaA__ALE31787

SEQ ID NO: 165829 - RNA, 1701 nt, Artificial Sequence; identical to SEQ ID NO: 165061
  derived and/or modified sequence opt4 from hemagglutinin__InfluenzaA__ALE31788

SEQ ID NO: 165830 - RNA, 1701 nt, Artificial Sequence; identical to SEQ ID NO: 164961
  derived and/or modified sequence opt4 from hemagglutinin__InfluenzaA__ALE31789

SEQ ID NO: 165831 - RNA, 1701 nt, Artificial Sequence; identical to SEQ ID NO: 165576
  derived and/or modified sequence opt4 from hemagglutinin__InfluenzaA__ALE31790

SEQ ID NO: 165832 - RNA, 1701 nt, Artificial Sequence; identical to SEQ ID NO: 165697
  derived and/or modified sequence opt4 from hemagglutinin__InfluenzaA__ALE31791

SEQ ID NO: 165833 - RNA, 1701 nt, Artificial Sequence; identical to SEQ ID NO: 165597
  derived and/or modified sequence opt4 from hemagglutinin__InfluenzaA__ALE31792

SEQ ID NO: 165834 - RNA, 1701 nt, Artificial Sequence
  derived and/or modified sequence opt4 from hemagglutinin__InfluenzaA__ALE31793
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucagccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165835 - RNA, 1701 nt, Artificial Sequence; identical to SEQ ID NO: 164961
  derived and/or modified sequence opt4 from hemagglutinin__InfluenzaA__ALE31794

SEQ ID NO: 165836 - RNA, 1701 nt, Artificial Sequence; identical to SEQ ID NO: 164961
  derived and/or modified sequence opt4 from hemagglutinin__InfluenzaA__ALE31795

SEQ ID NO: 165837 - RNA, 1701 nt, Artificial Sequence; identical to SEQ ID NO: 164961
  derived and/or modified sequence opt4 from hemagglutinin__InfluenzaA__ALE31796

SEQ ID NO: 165838 - RNA, 1701 nt, Artificial Sequence; identical to SEQ ID NO: 165619
  derived and/or modified sequence opt4 from hemagglutinin__InfluenzaA__ALE31797

SEQ ID NO: 165839 - RNA, 1701 nt, Artificial Sequence; identical to SEQ ID NO: 165619
  derived and/or modified sequence opt4 from hemagglutinin__InfluenzaA__ALE31798

SEQ ID NO: 165840 - RNA, 1701 nt, Artificial Sequence; identical to SEQ ID NO: 164961
  derived and/or modified sequence opt4 from hemagglutinin__InfluenzaA__ALE31799

SEQ ID NO: 165841 - RNA, 1701 nt, Artificial Sequence; identical to SEQ ID NO: 165567
  derived and/or modified sequence opt4 from hemagglutinin__InfluenzaA__ALE31800

SEQ ID NO: 165842 - RNA, 1701 nt, Artificial Sequence; identical to SEQ ID NO: 164961
  derived and/or modified sequence opt4 from hemagglutinin__InfluenzaA__ALE31801

SEQ ID NO: 165843 - RNA, 1701 nt, Artificial Sequence; identical to SEQ ID NO: 164961
  derived and/or modified sequence opt4 from hemagglutinin__InfluenzaA__ALE31802

SEQ ID NO: 165844 - RNA, 1701 nt, Artificial Sequence; identical to SEQ ID NO: 165567
  derived and/or modified sequence opt4 from hemagglutinin__InfluenzaA__ALE31803

SEQ ID NO: 165845 - RNA, 1701 nt, Artificial Sequence; identical to SEQ ID NO: 165518
  derived and/or modified sequence opt4 from hemagglutinin__InfluenzaA__ALE31805

SEQ ID NO: 165846 - RNA, 1701 nt, Artificial Sequence
  derived and/or modified sequence opt4 from hemagglutinin__InfluenzaA__ALE31806
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacacccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165847 - RNA, 1701 nt, Artificial Sequence
  derived and/or modified sequence opt4 from hemagglutinin__InfluenzaA__ALE31807
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuucaccuaccccgcccugaacgugaccaugcccaacaacgagcaguucgacaagcuguacguguggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165848 - RNA, 1701 nt, Artificial Sequence
  derived and/or modified sequence opt4 from hemagglutinin__InfluenzaA__ALE31808
augaagaccaucaucgcccugggcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccacaagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165849 - RNA, 1701 nt, Artificial Sequence; identical to SEQ ID NO: 164961
  derived and/or modified sequence opt4 from hemagglutinin__InfluenzaA__ALE31810

SEQ ID NO: 165850 - RNA, 1701 nt, Artificial Sequence; identical to SEQ ID NO: 164961
  derived and/or modified sequence opt4 from hemagglutinin__InfluenzaA__ALE31812

SEQ ID NO: 165851 - RNA, 1701 nt, Artificial Sequence
  derived and/or modified sequence opt4 from hemagglutinin__InfluenzaA__ALE31814
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagcccagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165852 - RNA, 1701 nt, Artificial Sequence; identical to SEQ ID NO: 165851
  derived and/or modified sequence opt4 from hemagglutinin__InfluenzaA__ALE31815

SEQ ID NO: 165853 - RNA, 1701 nt, Artificial Sequence; identical to SEQ ID NO: 164961
  derived and/or modified sequence opt4 from hemagglutinin__InfluenzaA__ALE31818

SEQ ID NO: 165854 - RNA, 1701 nt, Artificial Sequence
  derived and/or modified sequence opt4 from hemagglutinin__InfluenzaA__ALE31819
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcagcagcagcuucuucagcagacugaacuggcugacccaccugaacuacaccuaccccgcccugaacgugaccaugcccaacaaggagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165855 - RNA, 1701 nt, Artificial Sequence; identical to SEQ ID NO: 165505
  derived and/or modified sequence opt4 from hemagglutinin__InfluenzaA__ALE31820

SEQ ID NO: 165856 - RNA, 1701 nt, Artificial Sequence
  derived and/or modified sequence opt4 from hemagglutinin__InfluenzaA__ALE31821
augaagaccaucaucgcccugagcuacacccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165857 - RNA, 1701 nt, Artificial Sequence; identical to SEQ ID NO: 165597
  derived and/or modified sequence opt4 from hemagglutinin__InfluenzaA__ALE31822

SEQ ID NO: 165858 - RNA, 1701 nt, Artificial Sequence; identical to SEQ ID NO: 165505
  derived and/or modified sequence opt4 from hemagglutinin__InfluenzaA__ALE31823

SEQ ID NO: 165859 - RNA, 1701 nt, Artificial Sequence; identical to SEQ ID NO: 164961
  derived and/or modified sequence opt4 from hemagglutinin__InfluenzaA__ALE31824

SEQ ID NO: 165860 - RNA, 1701 nt, Artificial Sequence
  derived and/or modified sequence opt4 from hemagglutinin__InfluenzaA__ALE31825
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacagauaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165861 - RNA, 1701 nt, Artificial Sequence; identical to SEQ ID NO: 164961
  derived and/or modified sequence opt4 from hemagglutinin__InfluenzaA__ALE31826

SEQ ID NO: 165862 - RNA, 1701 nt, Artificial Sequence; identical to SEQ ID NO: 164961
  derived and/or modified sequence opt4 from hemagglutinin__InfluenzaA__ALE31827

SEQ ID NO: 165863 - RNA, 1701 nt, Artificial Sequence; identical to SEQ ID NO: 164961
  derived and/or modified sequence opt4 from hemagglutinin__InfluenzaA__ALE31828

SEQ ID NO: 165864 - RNA, 1701 nt, Artificial Sequence; identical to SEQ ID NO: 165518
  derived and/or modified sequence opt4 from hemagglutinin__InfluenzaA__ALE31829

SEQ ID NO: 165865 - RNA, 1701 nt, Artificial Sequence
  derived and/or modified sequence opt4 from hemagglutinin__InfluenzaA__ALE31830
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgacaucaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165866 - RNA, 1701 nt, Artificial Sequence
  derived and/or modified sequence opt4 from hemagglutinin__InfluenzaA__ALE31832
augaagaacaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165867 - RNA, 1701 nt, Artificial Sequence
  derived and/or modified sequence opt4 from hemagglutinin__InfluenzaA__ALE31833
augaagaccaucaucgcccugagcuacauccugugccuggugagcgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165868 - RNA, 1701 nt, Artificial Sequence
  derived and/or modified sequence opt4 from hemagglutinin__InfluenzaA__ALE31834
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165869 - RNA, 1701 nt, Artificial Sequence; identical to SEQ ID NO: 165619
  derived and/or modified sequence opt4 from hemagglutinin__InfluenzaA__ALE31835

SEQ ID NO: 165870 - RNA, 1701 nt, Artificial Sequence; identical to SEQ ID NO: 164961
  derived and/or modified sequence opt4 from hemagglutinin__InfluenzaA__ALE31836

SEQ ID NO: 165871 - RNA, 1701 nt, Artificial Sequence
  derived and/or modified sequence opt4 from hemagglutinin__InfluenzaA__ALE31837
augaagaccaucaucgcccugagcuacauccugugccugguguacgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165872 - RNA, 1701 nt, Artificial Sequence; identical to SEQ ID NO: 164961
  derived and/or modified sequence opt4 from hemagglutinin__InfluenzaA__ALE31838

SEQ ID NO: 165873 - RNA, 1701 nt, Artificial Sequence; identical to SEQ ID NO: 164961
  derived and/or modified sequence opt4 from hemagglutinin__InfluenzaA__ALE31839

SEQ ID NO: 165874 - RNA, 1701 nt, Artificial Sequence
  derived and/or modified sequence opt4 from hemagglutinin__InfluenzaA__ALE31840
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacugagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165875 - RNA, 1701 nt, Artificial Sequence; identical to SEQ ID NO: 164961
  derived and/or modified sequence opt4 from hemagglutinin__InfluenzaA__ALE31842

SEQ ID NO: 165876 - RNA, 1701 nt, Artificial Sequence
  derived and/or modified sequence opt4 from hemagglutinin__InfluenzaA__ALE31843
augcagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagauccugagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165877 - RNA, 1701 nt, Artificial Sequence; identical to SEQ ID NO: 165518
  derived and/or modified sequence opt4 from hemagglutinin__InfluenzaA__ALE31844

SEQ ID NO: 165878 - RNA, 1701 nt, Artificial Sequence; identical to SEQ ID NO: 165494
  derived and/or modified sequence opt4 from hemagglutinin__InfluenzaA__ALE31846

SEQ ID NO: 165879 - RNA, 1701 nt, Artificial Sequence; identical to SEQ ID NO: 164961
  derived and/or modified sequence opt4 from hemagglutinin__InfluenzaA__ALE31847

SEQ ID NO: 165880 - RNA, 1701 nt, Artificial Sequence; identical to SEQ ID NO: 164961
  derived and/or modified sequence opt4 from hemagglutinin__InfluenzaA__ALE31848

SEQ ID NO: 165881 - RNA, 1701 nt, Artificial Sequence
  derived and/or modified sequence opt4 from hemagglutinin__InfluenzaA__ALE31850
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagcccagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagagugaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165882 - RNA, 1701 nt, Artificial Sequence
  derived and/or modified sequence opt4 from hemagglutinin__InfluenzaA__ALE31851
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaucggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165883 - RNA, 1701 nt, Artificial Sequence; identical to SEQ ID NO: 165505
  derived and/or modified sequence opt4 from hemagglutinin__InfluenzaA__ALE31852

SEQ ID NO: 165884 - RNA, 1701 nt, Artificial Sequence
  derived and/or modified sequence opt4 from hemagglutinin__InfluenzaA__ALE31853
augaagaccaucaucgcccugagcuacauccugugccugguguucacccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165885 - RNA, 1701 nt, Artificial Sequence
  derived and/or modified sequence opt4 from hemagglutinin__InfluenzaA__ALE31854
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcagaugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165886 - RNA, 1701 nt, Artificial Sequence; identical to SEQ ID NO: 165647
  derived and/or modified sequence opt4 from hemagglutinin__InfluenzaA__ALE31855

SEQ ID NO: 165887 - RNA, 1701 nt, Artificial Sequence; identical to SEQ ID NO: 164961
  derived and/or modified sequence opt4 from hemagglutinin__InfluenzaA__ALE31856

SEQ ID NO: 165888 - RNA, 1701 nt, Artificial Sequence; identical to SEQ ID NO: 164961
  derived and/or modified sequence opt4 from hemagglutinin__InfluenzaA__ALE31857

SEQ ID NO: 165889 - RNA, 1701 nt, Artificial Sequence
  derived and/or modified sequence opt4 from hemagglutinin__InfluenzaA__ALE31858
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaaguacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165890 - RNA, 1701 nt, Artificial Sequence
  derived and/or modified sequence opt4 from hemagglutinin__InfluenzaA__ALE31859
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaccagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacaugcugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165891 - RNA, 1701 nt, Artificial Sequence
  derived and/or modified sequence opt4 from hemagglutinin__InfluenzaA__ALE31860
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcaagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcgagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165892 - RNA, 1701 nt, Artificial Sequence; identical to SEQ ID NO: 164961
  derived and/or modified sequence opt4 from hemagglutinin__InfluenzaA__ALE31861

SEQ ID NO: 165893 - RNA, 1701 nt, Artificial Sequence
  derived and/or modified sequence opt4 from hemagglutinin__InfluenzaA__ALE31862
augaagaugaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgaguuccugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165894 - RNA, 1701 nt, Artificial Sequence; identical to SEQ ID NO: 165619
  derived and/or modified sequence opt4 from hemagglutinin__InfluenzaA__ALE31863

SEQ ID NO: 165895 - RNA, 1701 nt, Artificial Sequence; identical to SEQ ID NO: 165619
  derived and/or modified sequence opt4 from hemagglutinin__InfluenzaA__ALE31865

SEQ ID NO: 165896 - RNA, 1701 nt, Artificial Sequence; identical to SEQ ID NO: 165619
  derived and/or modified sequence opt4 from hemagglutinin__InfluenzaA__ALE31866

SEQ ID NO: 165897 - RNA, 1701 nt, Artificial Sequence
  derived and/or modified sequence opt4 from hemagglutinin__InfluenzaA__ALE31867
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaacggcaacaucagaugcaacaucugcaucuga

SEQ ID NO: 165898 - RNA, 1701 nt, Artificial Sequence; identical to SEQ ID NO: 164961
  derived and/or modified sequence opt4 from hemagglutinin__InfluenzaA__ALE31868

SEQ ID NO: 165899 - RNA, 1701 nt, Artificial Sequence; identical to SEQ ID NO: 165897
  derived and/or modified sequence opt4 from hemagglutinin__InfluenzaA__ALE31869

SEQ ID NO: 165900 - RNA, 1701 nt, Artificial Sequence; identical to SEQ ID NO: 165897
  derived and/or modified sequence opt4 from hemagglutinin__InfluenzaA__ALE31870

SEQ ID NO: 165901 - RNA, 1701 nt, Artificial Sequence
  derived and/or modified sequence opt4 from hemagglutinin__InfluenzaA__ALE31871
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165902 - RNA, 1701 nt, Artificial Sequence; identical to SEQ ID NO: 164947
  derived and/or modified sequence opt4 from hemagglutinin__InfluenzaA__ALE31872

SEQ ID NO: 165903 - RNA, 1701 nt, Artificial Sequence; identical to SEQ ID NO: 164961
  derived and/or modified sequence opt4 from hemagglutinin__InfluenzaA__ALE31873

SEQ ID NO: 165904 - RNA, 1701 nt, Artificial Sequence
  derived and/or modified sequence opt4 from hemagglutinin__InfluenzaA__ALE31874
augaagaccaucaucgcccugagcuacauccugugccugguguucgcccagaagcugcccggcaacgacaacagcgccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165905 - RNA, 1701 nt, Artificial Sequence; identical to SEQ ID NO: 165904
  derived and/or modified sequence opt4 from hemagglutinin__InfluenzaA__ALE31875

SEQ ID NO: 165906 - RNA, 1701 nt, Artificial Sequence; identical to SEQ ID NO: 165904
  derived and/or modified sequence opt4 from hemagglutinin__InfluenzaA__ALE31876

SEQ ID NO: 165907 - RNA, 1701 nt, Artificial Sequence
  derived and/or modified sequence opt4 from hemagglutinin__InfluenzaA__ALE31877
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaucaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165908 - RNA, 1701 nt, Artificial Sequence; identical to SEQ ID NO: 164961
  derived and/or modified sequence opt4 from hemagglutinin__InfluenzaA__ALE31878

SEQ ID NO: 165909 - RNA, 1701 nt, Artificial Sequence; identical to SEQ ID NO: 164961
  derived and/or modified sequence opt4 from hemagglutinin__InfluenzaA__ALE31879

SEQ ID NO: 165910 - RNA, 1701 nt, Artificial Sequence; identical to SEQ ID NO: 164961
  derived and/or modified sequence opt4 from hemagglutinin__InfluenzaA__ALE31880

SEQ ID NO: 165911 - RNA, 1701 nt, Artificial Sequence
  derived and/or modified sequence opt4 from hemagglutinin__InfluenzaA__ALE31881
augaagaccaucaucgcccugagccacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugguggcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcaucgagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165912 - RNA, 1701 nt, Artificial Sequence; identical to SEQ ID NO: 164961
  derived and/or modified sequence opt4 from hemagglutinin__InfluenzaA__ALE31882

SEQ ID NO: 165913 - RNA, 1701 nt, Artificial Sequence; identical to SEQ ID NO: 164961
  derived and/or modified sequence opt4 from hemagglutinin__InfluenzaA__ALE31888

SEQ ID NO: 165914 - RNA, 1701 nt, Artificial Sequence; identical to SEQ ID NO: 164961
  derived and/or modified sequence opt4 from hemagglutinin__InfluenzaA__ALE31889

SEQ ID NO: 165915 - RNA, 1701 nt, Artificial Sequence; identical to SEQ ID NO: 165619
  derived and/or modified sequence opt4 from hemagglutinin__InfluenzaA__ALE31890

SEQ ID NO: 165916 - RNA, 1701 nt, Artificial Sequence; identical to SEQ ID NO: 165619
  derived and/or modified sequence opt4 from hemagglutinin__InfluenzaA__ALE31891

SEQ ID NO: 165917 - RNA, 1701 nt, Artificial Sequence; identical to SEQ ID NO: 164961
  derived and/or modified sequence opt4 from hemagglutinin__InfluenzaA__ALE31892

SEQ ID NO: 165918 - RNA, 1701 nt, Artificial Sequence; identical to SEQ ID NO: 164961
  derived and/or modified sequence opt4 from hemagglutinin__InfluenzaA__ALE31893

SEQ ID NO: 165919 - RNA, 1701 nt, Artificial Sequence; identical to SEQ ID NO: 165567
  derived and/or modified sequence opt4 from hemagglutinin__InfluenzaA__ALE31894

SEQ ID NO: 165920 - RNA, 1701 nt, Artificial Sequence; identical to SEQ ID NO: 164947
  derived and/or modified sequence opt4 from hemagglutinin__InfluenzaA__ALE31895

SEQ ID NO: 165921 - RNA, 1701 nt, Artificial Sequence; identical to SEQ ID NO: 164961
  derived and/or modified sequence opt4 from hemagglutinin__InfluenzaA__ALE31896

SEQ ID NO: 165922 - RNA, 1701 nt, Artificial Sequence; identical to SEQ ID NO: 164961
  derived and/or modified sequence opt4 from hemagglutinin__InfluenzaA__ALE31897

SEQ ID NO: 165923 - RNA, 1701 nt, Artificial Sequence; identical to SEQ ID NO: 164961
  derived and/or modified sequence opt4 from hemagglutinin__InfluenzaA__ALE31898

SEQ ID NO: 165924 - RNA, 1701 nt, Artificial Sequence
  derived and/or modified sequence opt4 from hemagglutinin__InfluenzaA__ALE31899
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaugaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165925 - RNA, 1701 nt, Artificial Sequence; identical to SEQ ID NO: 165567
  derived and/or modified sequence opt4 from hemagglutinin__InfluenzaA__ALE31901

SEQ ID NO: 165926 - RNA, 1701 nt, Artificial Sequence
  derived and/or modified sequence opt4 from hemagglutinin__InfluenzaA__ALE31902
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165927 - RNA, 1701 nt, Artificial Sequence; identical to SEQ ID NO: 164961
  derived and/or modified sequence opt4 from hemagglutinin__InfluenzaA__ALE31903

SEQ ID NO: 165928 - RNA, 1701 nt, Artificial Sequence; identical to SEQ ID NO: 164961
  derived and/or modified sequence opt4 from hemagglutinin__InfluenzaA__ALE31904

SEQ ID NO: 165929 - RNA, 1701 nt, Artificial Sequence
  derived and/or modified sequence opt4 from hemagglutinin__InfluenzaA__ALE31905
augaagaccaucaucgcccugggcuacauccugugccugggcuucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccacaagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165930 - RNA, 1701 nt, Artificial Sequence; identical to SEQ ID NO: 164961
  derived and/or modified sequence opt4 from hemagglutinin__InfluenzaA__ALE31906

SEQ ID NO: 165931 - RNA, 1701 nt, Artificial Sequence
  derived and/or modified sequence opt4 from hemagglutinin__InfluenzaA__ALE31907
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagagcggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165932 - RNA, 1701 nt, Artificial Sequence; identical to SEQ ID NO: 164961
  derived and/or modified sequence opt4 from hemagglutinin__InfluenzaA__ALE31908

SEQ ID NO: 165933 - RNA, 1701 nt, Artificial Sequence
  derived and/or modified sequence opt4 from hemagglutinin__InfluenzaA__ALE31909
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagagcggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165934 - RNA, 1701 nt, Artificial Sequence; identical to SEQ ID NO: 164961
  derived and/or modified sequence opt4 from hemagglutinin__InfluenzaA__ALE31910

SEQ ID NO: 165935 - RNA, 1701 nt, Artificial Sequence; identical to SEQ ID NO: 165884
  derived and/or modified sequence opt4 from hemagglutinin__InfluenzaA__ALE31912

SEQ ID NO: 165936 - RNA, 1701 nt, Artificial Sequence
  derived and/or modified sequence opt4 from hemagglutinin__InfluenzaA__ALE31913
augaagaccaucaucgcccugggcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccacaagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucgagagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165937 - RNA, 1701 nt, Artificial Sequence; identical to SEQ ID NO: 164961
  derived and/or modified sequence opt4 from hemagglutinin__InfluenzaA__ALE31914

SEQ ID NO: 165938 - RNA, 1701 nt, Artificial Sequence
  derived and/or modified sequence opt4 from hemagglutinin__InfluenzaA__ALE31915
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaguacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165939 - RNA, 1701 nt, Artificial Sequence; identical to SEQ ID NO: 164961
  derived and/or modified sequence opt4 from hemagglutinin__InfluenzaA__ALE31916

SEQ ID NO: 165940 - RNA, 1701 nt, Artificial Sequence; identical to SEQ ID NO: 164961
  derived and/or modified sequence opt4 from hemagglutinin__InfluenzaA__ALE31917

SEQ ID NO: 165941 - RNA, 1701 nt, Artificial Sequence; identical to SEQ ID NO: 165494
  derived and/or modified sequence opt4 from hemagglutinin__InfluenzaA__ALE31918

SEQ ID NO: 165942 - RNA, 1701 nt, Artificial Sequence; identical to SEQ ID NO: 165619
  derived and/or modified sequence opt4 from hemagglutinin__InfluenzaA__ALE31920

SEQ ID NO: 165943 - RNA, 1701 nt, Artificial Sequence; identical to SEQ ID NO: 164961
  derived and/or modified sequence opt4 from hemagglutinin__InfluenzaA__ALE31921

SEQ ID NO: 165944 - RNA, 1701 nt, Artificial Sequence; identical to SEQ ID NO: 164961
  derived and/or modified sequence opt4 from hemagglutinin__InfluenzaA__ALE31922

SEQ ID NO: 165945 - RNA, 1701 nt, Artificial Sequence; identical to SEQ ID NO: 165505
  derived and/or modified sequence opt4 from hemagglutinin__InfluenzaA__ALE31923

SEQ ID NO: 165946 - RNA, 1701 nt, Artificial Sequence; identical to SEQ ID NO: 164961
  derived and/or modified sequence opt4 from hemagglutinin__InfluenzaA__ALE31924

SEQ ID NO: 165947 - RNA, 1701 nt, Artificial Sequence; identical to SEQ ID NO: 164961
  derived and/or modified sequence opt4 from hemagglutinin__InfluenzaA__ALE31925

SEQ ID NO: 165948 - RNA, 1701 nt, Artificial Sequence
  derived and/or modified sequence opt4 from hemagglutinin__InfluenzaA__ALE31926
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagggcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165949 - RNA, 1701 nt, Artificial Sequence; identical to SEQ ID NO: 164961
  derived and/or modified sequence opt4 from hemagglutinin__InfluenzaA__ALE31927

SEQ ID NO: 165950 - RNA, 1701 nt, Artificial Sequence
  derived and/or modified sequence opt4 from hemagglutinin__InfluenzaA__ALE31928
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165951 - RNA, 1701 nt, Artificial Sequence; identical to SEQ ID NO: 165597
  derived and/or modified sequence opt4 from hemagglutinin__InfluenzaA__ALE31930

SEQ ID NO: 165952 - RNA, 1701 nt, Artificial Sequence; identical to SEQ ID NO: 164961
  derived and/or modified sequence opt4 from hemagglutinin__InfluenzaA__ALE31931

SEQ ID NO: 165953 - RNA, 1701 nt, Artificial Sequence; identical to SEQ ID NO: 164961
  derived and/or modified sequence opt4 from hemagglutinin__InfluenzaA__ALE31932

SEQ ID NO: 165954 - RNA, 1701 nt, Artificial Sequence
  derived and/or modified sequence opt4 from hemagglutinin__InfluenzaA__ALE31933
augaagaccaucaucgcccugagcuacauccugugccugguguacgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaaguacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165955 - RNA, 1701 nt, Artificial Sequence
  derived and/or modified sequence opt4 from hemagglutinin__InfluenzaA__ALE31934
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccaggcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacauccccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165956 - RNA, 1701 nt, Artificial Sequence; identical to SEQ ID NO: 164961
  derived and/or modified sequence opt4 from hemagglutinin__InfluenzaA__ALE31935

SEQ ID NO: 165957 - RNA, 1701 nt, Artificial Sequence; identical to SEQ ID NO: 165743
  derived and/or modified sequence opt4 from hemagglutinin__InfluenzaA__ALE31936

SEQ ID NO: 165958 - RNA, 1701 nt, Artificial Sequence
  derived and/or modified sequence opt4 from hemagglutinin__InfluenzaA__ALE31937
augaagaccaucaucgcccugagcuacauccugugccugguguucgcccagaagcugcccgagaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagcccagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165959 - RNA, 1701 nt, Artificial Sequence; identical to SEQ ID NO: 164961
  derived and/or modified sequence opt4 from hemagglutinin__InfluenzaA__ALE31938

SEQ ID NO: 165960 - RNA, 1701 nt, Artificial Sequence; identical to SEQ ID NO: 165567
  derived and/or modified sequence opt4 from hemagglutinin__InfluenzaA__ALE31939

SEQ ID NO: 165961 - RNA, 1701 nt, Artificial Sequence; identical to SEQ ID NO: 164961
  derived and/or modified sequence opt4 from hemagglutinin__InfluenzaA__ALE31941

SEQ ID NO: 165962 - RNA, 1701 nt, Artificial Sequence; identical to SEQ ID NO: 165518
  derived and/or modified sequence opt4 from hemagglutinin__InfluenzaA__ALE31943

SEQ ID NO: 165963 - RNA, 1701 nt, Artificial Sequence
  derived and/or modified sequence opt4 from hemagglutinin__InfluenzaA__ALE31944
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165964 - RNA, 1701 nt, Artificial Sequence
  derived and/or modified sequence opt4 from hemagglutinin__InfluenzaA__ALE31945
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagggcagccagcaggccgugauccccaacgugggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggacaucgagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165965 - RNA, 1701 nt, Artificial Sequence; identical to SEQ ID NO: 165619
  derived and/or modified sequence opt4 from hemagglutinin__InfluenzaA__ALE31946

SEQ ID NO: 165966 - RNA, 1701 nt, Artificial Sequence; identical to SEQ ID NO: 165619
  derived and/or modified sequence opt4 from hemagglutinin__InfluenzaA__ALE31947

SEQ ID NO: 165967 - RNA, 1701 nt, Artificial Sequence
  derived and/or modified sequence opt4 from hemagglutinin__InfluenzaA__ALE31948
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacuggugggcaagaccaacgagaaguuccaccagaucgagaaggaguucagcgagguggagggcagaauccaggaccuggagaaguacguggaggacaccaagaucgaccuguggagcuacaacgccgaguuccugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165968 - RNA, 1701 nt, Artificial Sequence; identical to SEQ ID NO: 165619
  derived and/or modified sequence opt4 from hemagglutinin__InfluenzaA__ALE31949

SEQ ID NO: 165969 - RNA, 1701 nt, Artificial Sequence; identical to SEQ ID NO: 164961
  derived and/or modified sequence opt4 from hemagglutinin__InfluenzaA__ALE31950

SEQ ID NO: 165970 - RNA, 1701 nt, Artificial Sequence; identical to SEQ ID NO: 165505
  derived and/or modified sequence opt4 from hemagglutinin__InfluenzaA__ALE31951

SEQ ID NO: 165971 - RNA, 1701 nt, Artificial Sequence; identical to SEQ ID NO: 164961
  derived and/or modified sequence opt4 from hemagglutinin__InfluenzaA__ALE31952

SEQ ID NO: 165972 - RNA, 1701 nt, Artificial Sequence
  derived and/or modified sequence opt4 from hemagglutinin__InfluenzaA__ALE31953
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguucgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165973 - RNA, 1701 nt, Artificial Sequence
  derived and/or modified sequence opt4 from hemagglutinin__InfluenzaA__ALE31954
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagagaugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccacagcagcggcagaaucaccgugagcaccaagagaagccagcaggccgugauccccaacgugggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacuggugggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacuacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165974 - RNA, 1701 nt, Artificial Sequence; identical to SEQ ID NO: 164961
  derived and/or modified sequence opt4 from hemagglutinin__InfluenzaA__ALE31955

SEQ ID NO: 165975 - RNA, 1701 nt, Artificial Sequence
  derived and/or modified sequence opt4 from hemagglutinin__InfluenzaA__ALE31956
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165976 - RNA, 1701 nt, Artificial Sequence; identical to SEQ ID NO: 165567
  derived and/or modified sequence opt4 from hemagglutinin__InfluenzaA__ALE31957

SEQ ID NO: 165977 - RNA, 1701 nt, Artificial Sequence
  derived and/or modified sequence opt4 from hemagglutinin__InfluenzaA__ALE31958
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcaagcccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165978 - RNA, 1701 nt, Artificial Sequence
  derived and/or modified sequence opt4 from hemagglutinin__InfluenzaA__ALE31959
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacgccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165979 - RNA, 1701 nt, Artificial Sequence; identical to SEQ ID NO: 164961
  derived and/or modified sequence opt4 from hemagglutinin__InfluenzaA__ALE31960

SEQ ID NO: 165980 - RNA, 1701 nt, Artificial Sequence; identical to SEQ ID NO: 165150
  derived and/or modified sequence opt4 from hemagglutinin__InfluenzaA__ALE31961

SEQ ID NO: 165981 - RNA, 1701 nt, Artificial Sequence
  derived and/or modified sequence opt4 from hemagglutinin__InfluenzaA__ALE31962
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165982 - RNA, 1701 nt, Artificial Sequence
  derived and/or modified sequence opt4 from hemagglutinin__InfluenzaA__ALE31963
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaccuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165983 - RNA, 1701 nt, Artificial Sequence
  derived and/or modified sequence opt4 from hemagglutinin__InfluenzaA__ALE31964
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacuacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165984 - RNA, 1701 nt, Artificial Sequence; identical to SEQ ID NO: 164961
  derived and/or modified sequence opt4 from hemagglutinin__InfluenzaA__ALE31965

SEQ ID NO: 165985 - RNA, 1701 nt, Artificial Sequence; identical to SEQ ID NO: 165619
  derived and/or modified sequence opt4 from hemagglutinin__InfluenzaA__ALE31966

SEQ ID NO: 165986 - RNA, 1701 nt, Artificial Sequence; identical to SEQ ID NO: 165889
  derived and/or modified sequence opt4 from hemagglutinin__InfluenzaA__ALE31967

SEQ ID NO: 165987 - RNA, 1701 nt, Artificial Sequence; identical to SEQ ID NO: 165505
  derived and/or modified sequence opt4 from hemagglutinin__InfluenzaA__ALE31968

SEQ ID NO: 165988 - RNA, 1701 nt, Artificial Sequence; identical to SEQ ID NO: 165612
  derived and/or modified sequence opt4 from hemagglutinin__InfluenzaA__ALE31969

SEQ ID NO: 165989 - RNA, 1701 nt, Artificial Sequence; identical to SEQ ID NO: 164961
  derived and/or modified sequence opt4 from hemagglutinin__InfluenzaA__ALE31970

SEQ ID NO: 165990 - RNA, 1701 nt, Artificial Sequence
  derived and/or modified sequence opt4 from hemagglutinin__InfluenzaA__ALE31971
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacgccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165991 - RNA, 1701 nt, Artificial Sequence; identical to SEQ ID NO: 165505
  derived and/or modified sequence opt4 from hemagglutinin__InfluenzaA__ALE31972

SEQ ID NO: 165992 - RNA, 1701 nt, Artificial Sequence; identical to SEQ ID NO: 165505
  derived and/or modified sequence opt4 from hemagglutinin__InfluenzaA__ALE31973

SEQ ID NO: 165993 - RNA, 1701 nt, Artificial Sequence; identical to SEQ ID NO: 165150
  derived and/or modified sequence opt4 from hemagglutinin__InfluenzaA__ALE31974

SEQ ID NO: 165994 - RNA, 1701 nt, Artificial Sequence; identical to SEQ ID NO: 165505
  derived and/or modified sequence opt4 from hemagglutinin__InfluenzaA__ALE31975

SEQ ID NO: 165995 - RNA, 1701 nt, Artificial Sequence; identical to SEQ ID NO: 164961
  derived and/or modified sequence opt4 from hemagglutinin__InfluenzaA__ALE31976

SEQ ID NO: 165996 - RNA, 1701 nt, Artificial Sequence; identical to SEQ ID NO: 164961
  derived and/or modified sequence opt4 from hemagglutinin__InfluenzaA__ALE31977

SEQ ID NO: 165997 - RNA, 1701 nt, Artificial Sequence
  derived and/or modified sequence opt4 from hemagglutinin__InfluenzaA__ALE31978
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugauccacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 165998 - RNA, 1701 nt, Artificial Sequence; identical to SEQ ID NO: 164961
  derived and/or modified sequence opt4 from hemagglutinin__InfluenzaA__ALE31979

SEQ ID NO: 165999 - RNA, 1701 nt, Artificial Sequence
  derived and/or modified sequence opt4 from hemagglutinin__InfluenzaA__ALE31980
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcgaguacaaggacuggauccuguggaucagcuucgccaucagcugcuuccugcugugcguggcccugcugggcuucaucaugugggccugccagaagggcaacaucagaugcaacaucugcaucuga

SEQ ID NO: 166000 - RNA, 1701 nt, Artificial Sequence; identical to SEQ ID NO: 164961
  derived and/or modified sequence opt4 from hemagglutinin__InfluenzaA__ALE31981

SEQ ID NO: 166001 - RNA, 1701 nt, Artificial Sequence; identical to SEQ ID NO: 165501
  derived and/or modified sequence opt4 from hemagglutinin__InfluenzaA__ALE31995

SEQ ID NO: 166002 - RNA, 1701 nt, Artificial Sequence
  derived and/or modified sequence opt4 from hemagglutinin__InfluenzaA__ALE31996
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagagugaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166003 - RNA, 1701 nt, Artificial Sequence
  derived and/or modified sequence opt4 from hemagglutinin__InfluenzaA__ALE31997
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166004 - RNA, 1701 nt, Artificial Sequence; identical to SEQ ID NO: 164961
  derived and/or modified sequence opt4 from hemagglutinin__InfluenzaA__ALE31998

SEQ ID NO: 166005 - RNA, 1701 nt, Artificial Sequence
  derived and/or modified sequence opt4 from hemagglutinin__InfluenzaA__ALE31999
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugcacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166006 - RNA, 1701 nt, Artificial Sequence
  derived and/or modified sequence opt4 from hemagglutinin__InfluenzaA__ALE32000
augaagaccaucaucgcccugagccacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166007 - RNA, 1701 nt, Artificial Sequence; identical to SEQ ID NO: 164961
  derived and/or modified sequence opt4 from hemagglutinin__InfluenzaA__ALE32001

SEQ ID NO: 166008 - RNA, 1701 nt, Artificial Sequence; identical to SEQ ID NO: 164961
  derived and/or modified sequence opt4 from hemagglutinin__InfluenzaA__ALE32002

SEQ ID NO: 166009 - RNA, 1701 nt, Artificial Sequence; identical to SEQ ID NO: 165061
  derived and/or modified sequence opt4 from hemagglutinin__InfluenzaA__ALE32003

SEQ ID NO: 166010 - RNA, 1701 nt, Artificial Sequence; identical to SEQ ID NO: 164961
  derived and/or modified sequence opt4 from hemagglutinin__InfluenzaA__ALE32004

SEQ ID NO: 166011 - RNA, 1701 nt, Artificial Sequence; identical to SEQ ID NO: 164961
  derived and/or modified sequence opt4 from hemagglutinin__InfluenzaA__ALE32005

SEQ ID NO: 166012 - RNA, 1701 nt, Artificial Sequence; identical to SEQ ID NO: 165505
  derived and/or modified sequence opt4 from hemagglutinin__InfluenzaA__ALE32006

SEQ ID NO: 166013 - RNA, 1701 nt, Artificial Sequence; identical to SEQ ID NO: 164961
  derived and/or modified sequence opt4 from hemagglutinin__InfluenzaA__ALE32007

SEQ ID NO: 166014 - RNA, 1701 nt, Artificial Sequence; identical to SEQ ID NO: 165512
  derived and/or modified sequence opt4 from hemagglutinin__InfluenzaA__ALE32008

SEQ ID NO: 166015 - RNA, 1701 nt, Artificial Sequence
  derived and/or modified sequence opt4 from hemagglutinin__InfluenzaA__ALE32009
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgugcugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccaggagggcaacaucagaugcaacaucugcaucuga

SEQ ID NO: 166016 - RNA, 1701 nt, Artificial Sequence
  derived and/or modified sequence opt4 from hemagglutinin__InfluenzaA__ALE32010
augaagaccaucaucgcccugagcuacauccugugccuggccuucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugcacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166017 - RNA, 1701 nt, Artificial Sequence; identical to SEQ ID NO: 165975
  derived and/or modified sequence opt4 from hemagglutinin__InfluenzaA__ALE32011

SEQ ID NO: 166018 - RNA, 1701 nt, Artificial Sequence; identical to SEQ ID NO: 165518
  derived and/or modified sequence opt4 from hemagglutinin__InfluenzaA__ALE32012

SEQ ID NO: 166019 - RNA, 1701 nt, Artificial Sequence; identical to SEQ ID NO: 164961
  derived and/or modified sequence opt4 from hemagglutinin__InfluenzaA__ALE32013

SEQ ID NO: 166020 - RNA, 1701 nt, Artificial Sequence
  derived and/or modified sequence opt4 from hemagglutinin__InfluenzaA__ALE32014
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccagcugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166021 - RNA, 1701 nt, Artificial Sequence; identical to SEQ ID NO: 165846
  derived and/or modified sequence opt4 from hemagglutinin__InfluenzaA__ALE32015

SEQ ID NO: 166022 - RNA, 1701 nt, Artificial Sequence; identical to SEQ ID NO: 164961
  derived and/or modified sequence opt4 from hemagglutinin__InfluenzaA__ALE32016

SEQ ID NO: 166023 - RNA, 1701 nt, Artificial Sequence; identical to SEQ ID NO: 164961
  derived and/or modified sequence opt4 from hemagglutinin__InfluenzaA__ALE32017

SEQ ID NO: 166024 - RNA, 1701 nt, Artificial Sequence; identical to SEQ ID NO: 164961
  derived and/or modified sequence opt4 from hemagglutinin__InfluenzaA__ALE32018

SEQ ID NO: 166025 - RNA, 1701 nt, Artificial Sequence; identical to SEQ ID NO: 165505
  derived and/or modified sequence opt4 from hemagglutinin__InfluenzaA__ALE32020

SEQ ID NO: 166026 - RNA, 1701 nt, Artificial Sequence; identical to SEQ ID NO: 165612
  derived and/or modified sequence opt4 from hemagglutinin__InfluenzaA__ALE32021

SEQ ID NO: 166027 - RNA, 1701 nt, Artificial Sequence; identical to SEQ ID NO: 165692
  derived and/or modified sequence opt4 from hemagglutinin__InfluenzaA__ALE32022

SEQ ID NO: 166028 - RNA, 1701 nt, Artificial Sequence; identical to SEQ ID NO: 164961
  derived and/or modified sequence opt4 from hemagglutinin__InfluenzaA__ALE32023

SEQ ID NO: 166029 - RNA, 1701 nt, Artificial Sequence
  derived and/or modified sequence opt4 from hemagglutinin__InfluenzaA__ALE32024
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagagaugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaagagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccacagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaagagcgagugcaucacccccaacggcagcauccccaacgacaagcccuuccagaacgugaacagaaucaccuacggcaccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacuacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166030 - RNA, 1701 nt, Artificial Sequence
  derived and/or modified sequence opt4 from hemagglutinin__InfluenzaA__ALE32025
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagagcggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugagcaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166031 - RNA, 1701 nt, Artificial Sequence; identical to SEQ ID NO: 164961
  derived and/or modified sequence opt4 from hemagglutinin__InfluenzaA__ALE32026

SEQ ID NO: 166032 - RNA, 1701 nt, Artificial Sequence; identical to SEQ ID NO: 165505
  derived and/or modified sequence opt4 from hemagglutinin__InfluenzaA__ALE32027

SEQ ID NO: 166033 - RNA, 1701 nt, Artificial Sequence
  derived and/or modified sequence opt4 from hemagglutinin__InfluenzaA__ALE32028
augaagaccaucaucgcccugagccacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166034 - RNA, 1701 nt, Artificial Sequence; identical to SEQ ID NO: 165612
  derived and/or modified sequence opt4 from hemagglutinin__InfluenzaA__ALE32029

SEQ ID NO: 166035 - RNA, 1701 nt, Artificial Sequence
  derived and/or modified sequence opt4 from hemagglutinin__InfluenzaA__ALE32030
augaagaccaucaucgcccugagccacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaucuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166036 - RNA, 1701 nt, Artificial Sequence
  derived and/or modified sequence opt4 from hemagglutinin__InfluenzaA__ALE32031
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166037 - RNA, 1701 nt, Artificial Sequence
  derived and/or modified sequence opt4 from hemagglutinin__InfluenzaA__ALE32032
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucgccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166038 - RNA, 1701 nt, Artificial Sequence; identical to SEQ ID NO: 164961
  derived and/or modified sequence opt4 from hemagglutinin__InfluenzaA__ALE32033

SEQ ID NO: 166039 - RNA, 1701 nt, Artificial Sequence
  derived and/or modified sequence opt4 from hemagglutinin__InfluenzaA__ALE32034
augaagaccaucaucgcccugggcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccacaagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaaguacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166040 - RNA, 1701 nt, Artificial Sequence; identical to SEQ ID NO: 165851
  derived and/or modified sequence opt4 from hemagglutinin__InfluenzaA__ALE32035

SEQ ID NO: 166041 - RNA, 1701 nt, Artificial Sequence
  derived and/or modified sequence opt4 from hemagglutinin__InfluenzaA__ALE32036
augaagaccaucaucgcccugggcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccacaagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugcacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166042 - RNA, 1701 nt, Artificial Sequence
  derived and/or modified sequence opt4 from hemagglutinin__InfluenzaA__ALE32037
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagauccugagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166043 - RNA, 1701 nt, Artificial Sequence
  derived and/or modified sequence opt4 from hemagglutinin__InfluenzaA__ALE32038
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaagggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccugaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166044 - RNA, 1701 nt, Artificial Sequence; identical to SEQ ID NO: 165619
  derived and/or modified sequence opt4 from hemagglutinin__InfluenzaA__ALE32039

SEQ ID NO: 166045 - RNA, 1701 nt, Artificial Sequence
  derived and/or modified sequence opt4 from hemagglutinin__InfluenzaA__ALE32040
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaccagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166046 - RNA, 1701 nt, Artificial Sequence; identical to SEQ ID NO: 164961
  derived and/or modified sequence opt4 from hemagglutinin__InfluenzaA__ALE32041

SEQ ID NO: 166047 - RNA, 1701 nt, Artificial Sequence; identical to SEQ ID NO: 164961
  derived and/or modified sequence opt4 from hemagglutinin__InfluenzaA__ALE32042

SEQ ID NO: 166048 - RNA, 1701 nt, Artificial Sequence
  derived and/or modified sequence opt4 from hemagglutinin__InfluenzaA__ALE32043
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacaccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166049 - RNA, 1701 nt, Artificial Sequence; identical to SEQ ID NO: 164961
  derived and/or modified sequence opt4 from hemagglutinin__InfluenzaA__ALE32044

SEQ ID NO: 166050 - RNA, 1701 nt, Artificial Sequence; identical to SEQ ID NO: 164961
  derived and/or modified sequence opt4 from hemagglutinin__InfluenzaA__ALE32045

SEQ ID NO: 166051 - RNA, 1701 nt, Artificial Sequence; identical to SEQ ID NO: 164961
  derived and/or modified sequence opt4 from hemagglutinin__InfluenzaA__ALE32046

SEQ ID NO: 166052 - RNA, 1701 nt, Artificial Sequence
  derived and/or modified sequence opt4 from hemagglutinin__InfluenzaA__ALE32047
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccaggugcuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugaucagcgacgcccccaucggcaagugcaagagcgagugcaucacccccaacggcagcauccccagcgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166053 - RNA, 1701 nt, Artificial Sequence; identical to SEQ ID NO: 164961
  derived and/or modified sequence opt4 from hemagglutinin__InfluenzaA__ALE32048

SEQ ID NO: 166054 - RNA, 1701 nt, Artificial Sequence; identical to SEQ ID NO: 165619
  derived and/or modified sequence opt4 from hemagglutinin__InfluenzaA__ALE32049

SEQ ID NO: 166055 - RNA, 1701 nt, Artificial Sequence
  derived and/or modified sequence opt4 from hemagglutinin__InfluenzaA__ALE32050
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccaggacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166056 - RNA, 1701 nt, Artificial Sequence
  derived and/or modified sequence opt4 from hemagglutinin__InfluenzaA__ALE32051
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagagugaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaucaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166057 - RNA, 1701 nt, Artificial Sequence; identical to SEQ ID NO: 164961
  derived and/or modified sequence opt4 from hemagglutinin__InfluenzaA__ALE32052

SEQ ID NO: 166058 - RNA, 1701 nt, Artificial Sequence; identical to SEQ ID NO: 164961
  derived and/or modified sequence opt4 from hemagglutinin__InfluenzaA__ALE32053

SEQ ID NO: 166059 - RNA, 1701 nt, Artificial Sequence
  derived and/or modified sequence opt4 from hemagglutinin__InfluenzaA__ALE32054
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgagagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaaccacugcaucuga

SEQ ID NO: 166060 - RNA, 1701 nt, Artificial Sequence
  derived and/or modified sequence opt4 from hemagglutinin__InfluenzaA__ALE32055
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaacggcaacaucagaugcaacaucugcaucuga

SEQ ID NO: 166061 - RNA, 1701 nt, Artificial Sequence; identical to SEQ ID NO: 165612
  derived and/or modified sequence opt4 from hemagglutinin__InfluenzaA__ALE32056

SEQ ID NO: 166062 - RNA, 1701 nt, Artificial Sequence
  derived and/or modified sequence opt4 from hemagglutinin__InfluenzaA__ALE32057
augaagaccaucaucgcccugagcuacgugcugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166063 - RNA, 1701 nt, Artificial Sequence; identical to SEQ ID NO: 164961
  derived and/or modified sequence opt4 from hemagglutinin__InfluenzaA__ALE32058

SEQ ID NO: 166064 - RNA, 1701 nt, Artificial Sequence; identical to SEQ ID NO: 164961
  derived and/or modified sequence opt4 from hemagglutinin__InfluenzaA__ALE32059

SEQ ID NO: 166065 - RNA, 1701 nt, Artificial Sequence
  derived and/or modified sequence opt4 from hemagglutinin__InfluenzaA__ALE32060
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagguguuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugauccacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166066 - RNA, 1701 nt, Artificial Sequence
  derived and/or modified sequence opt4 from hemagglutinin__InfluenzaA__ALE32061
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaaguacaccuaccccgcccugaacgugaccaugcccaacaacgagcaguucgacaagcuguacaucuggggcgugcaccaccccggcaccgacaacgaccagaucuuccuguacgccagaagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166067 - RNA, 1701 nt, Artificial Sequence
  derived and/or modified sequence opt4 from hemagglutinin__InfluenzaA__ALE32062
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucuacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166068 - RNA, 1701 nt, Artificial Sequence; identical to SEQ ID NO: 164961
  derived and/or modified sequence opt4 from hemagglutinin__InfluenzaA__ALE32063

SEQ ID NO: 166069 - RNA, 1701 nt, Artificial Sequence
  derived and/or modified sequence opt4 from hemagglutinin__InfluenzaA__ALE32064
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcaacagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaucggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166070 - RNA, 1701 nt, Artificial Sequence; identical to SEQ ID NO: 164961
  derived and/or modified sequence opt4 from hemagglutinin__InfluenzaA__ALE32065

SEQ ID NO: 166071 - RNA, 1701 nt, Artificial Sequence
  derived and/or modified sequence opt4 from hemagglutinin__InfluenzaA__ALE32066
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugagcaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166072 - RNA, 1701 nt, Artificial Sequence; identical to SEQ ID NO: 165743
  derived and/or modified sequence opt4 from hemagglutinin__InfluenzaA__ALE32067

SEQ ID NO: 166073 - RNA, 1701 nt, Artificial Sequence; identical to SEQ ID NO: 164961
  derived and/or modified sequence opt4 from hemagglutinin__InfluenzaA__ALE32068

SEQ ID NO: 166074 - RNA, 1701 nt, Artificial Sequence; identical to SEQ ID NO: 164961
  derived and/or modified sequence opt4 from hemagglutinin__InfluenzaA__ALE32069

SEQ ID NO: 166075 - RNA, 1701 nt, Artificial Sequence
  derived and/or modified sequence opt4 from hemagglutinin__InfluenzaA__ALE32070
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgugugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166076 - RNA, 1701 nt, Artificial Sequence; identical to SEQ ID NO: 164961
  derived and/or modified sequence opt4 from hemagglutinin__InfluenzaA__ALE32071

SEQ ID NO: 166077 - RNA, 1701 nt, Artificial Sequence; identical to SEQ ID NO: 165958
  derived and/or modified sequence opt4 from hemagglutinin__InfluenzaA__ALE32072

SEQ ID NO: 166078 - RNA, 1701 nt, Artificial Sequence
  derived and/or modified sequence opt4 from hemagglutinin__InfluenzaA__ALE32073
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagauccugagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166079 - RNA, 1701 nt, Artificial Sequence
  derived and/or modified sequence opt4 from hemagglutinin__InfluenzaA__ALE32074
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagauccugagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166080 - RNA, 1701 nt, Artificial Sequence
  derived and/or modified sequence opt4 from hemagglutinin__InfluenzaA__ALE32075
augaagaccaucaucgcccugagcuacauccugugccugguguucgcccagaagcugcccgagaacgacaacagcaccgccacccugugccugggccaccacgccgugcccaacggcaccaucgugaagaccaucaccagcgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcagcugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166081 - RNA, 1701 nt, Artificial Sequence; identical to SEQ ID NO: 165518
  derived and/or modified sequence opt4 from hemagglutinin__InfluenzaA__ALE32076

SEQ ID NO: 166082 - RNA, 1701 nt, Artificial Sequence
  derived and/or modified sequence opt4 from hemagglutinin__InfluenzaA__ALE32077
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166083 - RNA, 1701 nt, Artificial Sequence; identical to SEQ ID NO: 165619
  derived and/or modified sequence opt4 from hemagglutinin__InfluenzaA__ALE32078

SEQ ID NO: 166084 - RNA, 1701 nt, Artificial Sequence; identical to SEQ ID NO: 165505
  derived and/or modified sequence opt4 from hemagglutinin__InfluenzaA__ALE32079

SEQ ID NO: 166085 - RNA, 1701 nt, Artificial Sequence
  derived and/or modified sequence opt4 from hemagglutinin__InfluenzaA__ALE32080
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166086 - RNA, 1701 nt, Artificial Sequence; identical to SEQ ID NO: 165619
  derived and/or modified sequence opt4 from hemagglutinin__InfluenzaA__ALE32081

SEQ ID NO: 166087 - RNA, 1701 nt, Artificial Sequence; identical to SEQ ID NO: 165619
  derived and/or modified sequence opt4 from hemagglutinin__InfluenzaA__ALE32082

SEQ ID NO: 166088 - RNA, 1701 nt, Artificial Sequence
  derived and/or modified sequence opt4 from hemagglutinin__InfluenzaA__ALE32083
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagggcagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166089 - RNA, 1701 nt, Artificial Sequence; identical to SEQ ID NO: 165576
  derived and/or modified sequence opt4 from hemagglutinin__InfluenzaA__ALE32084

SEQ ID NO: 166090 - RNA, 1701 nt, Artificial Sequence; identical to SEQ ID NO: 165619
  derived and/or modified sequence opt4 from hemagglutinin__InfluenzaA__ALE32085

SEQ ID NO: 166091 - RNA, 1701 nt, Artificial Sequence
  derived and/or modified sequence opt4 from hemagglutinin__InfluenzaA__ALE32086
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucagcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166092 - RNA, 1701 nt, Artificial Sequence
  derived and/or modified sequence opt4 from hemagglutinin__InfluenzaA__ALE32087
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccuggacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaaccugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166093 - RNA, 1701 nt, Artificial Sequence
  derived and/or modified sequence opt4 from hemagglutinin__InfluenzaA__ALE32088
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcugcaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccguggaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166094 - RNA, 1701 nt, Artificial Sequence; identical to SEQ ID NO: 164961
  derived and/or modified sequence opt4 from hemagglutinin__InfluenzaA__ALE32089

SEQ ID NO: 166095 - RNA, 1701 nt, Artificial Sequence; identical to SEQ ID NO: 164961
  derived and/or modified sequence opt4 from hemagglutinin__InfluenzaA__ALE32090

SEQ ID NO: 166096 - RNA, 1701 nt, Artificial Sequence; identical to SEQ ID NO: 164961
  derived and/or modified sequence opt4 from hemagglutinin__InfluenzaA__ALE32091

SEQ ID NO: 166097 - RNA, 1701 nt, Artificial Sequence
  derived and/or modified sequence opt4 from hemagglutinin__InfluenzaA__ALE32092
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcagaagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgagcacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166098 - RNA, 1701 nt, Artificial Sequence; identical to SEQ ID NO: 165567
  derived and/or modified sequence opt4 from hemagglutinin__InfluenzaA__ALE32093

SEQ ID NO: 166099 - RNA, 1701 nt, Artificial Sequence
  derived and/or modified sequence opt4 from hemagglutinin__InfluenzaA__ALE32094
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaccagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166100 - RNA, 1701 nt, Artificial Sequence; identical to SEQ ID NO: 164961
  derived and/or modified sequence opt4 from hemagglutinin__InfluenzaA__ALE32095

SEQ ID NO: 166101 - RNA, 1701 nt, Artificial Sequence
  derived and/or modified sequence opt4 from hemagglutinin__InfluenzaA__ALE32096
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugagcuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166102 - RNA, 1701 nt, Artificial Sequence; identical to SEQ ID NO: 164961
  derived and/or modified sequence opt4 from hemagglutinin__InfluenzaA__ALE32097

SEQ ID NO: 166103 - RNA, 1701 nt, Artificial Sequence; identical to SEQ ID NO: 165567
  derived and/or modified sequence opt4 from hemagglutinin__InfluenzaA__ALE32099

SEQ ID NO: 166104 - RNA, 1701 nt, Artificial Sequence
  derived and/or modified sequence opt4 from hemagglutinin__InfluenzaA__ALE32100
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgaccugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166105 - RNA, 1701 nt, Artificial Sequence
  derived and/or modified sequence opt4 from hemagglutinin__InfluenzaA__ALE32101
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagccagugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcggcagcuucuucagcagacugaacuggcugacccaccugaaguacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166106 - RNA, 1701 nt, Artificial Sequence
  derived and/or modified sequence opt4 from hemagglutinin__InfluenzaA__ALE32102
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaaguacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugagcaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166107 - RNA, 1701 nt, Artificial Sequence; identical to SEQ ID NO: 165674
  derived and/or modified sequence opt4 from hemagglutinin__InfluenzaA__ALE32103

SEQ ID NO: 166108 - RNA, 1701 nt, Artificial Sequence
  derived and/or modified sequence opt4 from hemagglutinin__InfluenzaA__ALE32104
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166109 - RNA, 1701 nt, Artificial Sequence; identical to SEQ ID NO: 165619
  derived and/or modified sequence opt4 from hemagglutinin__InfluenzaA__ALE32105

SEQ ID NO: 166110 - RNA, 1701 nt, Artificial Sequence; identical to SEQ ID NO: 165619
  derived and/or modified sequence opt4 from hemagglutinin__InfluenzaA__ALE32106

SEQ ID NO: 166111 - RNA, 1701 nt, Artificial Sequence; identical to SEQ ID NO: 165674
  derived and/or modified sequence opt4 from hemagglutinin__InfluenzaA__ALE32107

SEQ ID NO: 166112 - RNA, 1701 nt, Artificial Sequence; identical to SEQ ID NO: 165904
  derived and/or modified sequence opt4 from hemagglutinin__InfluenzaA__ALE32108

SEQ ID NO: 166113 - RNA, 1701 nt, Artificial Sequence; identical to SEQ ID NO: 165518
  derived and/or modified sequence opt4 from hemagglutinin__InfluenzaA__ALE32109

SEQ ID NO: 166114 - RNA, 1701 nt, Artificial Sequence; identical to SEQ ID NO: 165505
  derived and/or modified sequence opt4 from hemagglutinin__InfluenzaA__ALE32110

SEQ ID NO: 166115 - RNA, 1701 nt, Artificial Sequence; identical to SEQ ID NO: 164961
  derived and/or modified sequence opt4 from hemagglutinin__InfluenzaA__ALE32111

SEQ ID NO: 166116 - RNA, 1701 nt, Artificial Sequence
  derived and/or modified sequence opt4 from hemagglutinin__InfluenzaA__ALE32112
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacgccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166117 - RNA, 1701 nt, Artificial Sequence
  derived and/or modified sequence opt4 from hemagglutinin__InfluenzaA__ALE32113
augaagaccaucaucgcccugagcuacauccugugccugguguucgcccagaagauccccggcaacgacaacagcaccgccacccugugccugggccaccacgccgugcccaacggcaccguggugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaugagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166118 - RNA, 1701 nt, Artificial Sequence; identical to SEQ ID NO: 165505
  derived and/or modified sequence opt4 from hemagglutinin__InfluenzaA__ALE32114

SEQ ID NO: 166119 - RNA, 1701 nt, Artificial Sequence; identical to SEQ ID NO: 165505
  derived and/or modified sequence opt4 from hemagglutinin__InfluenzaA__ALE32115

SEQ ID NO: 166120 - RNA, 1701 nt, Artificial Sequence
  derived and/or modified sequence opt4 from hemagglutinin__InfluenzaA__ALE32116
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacgugagaugcaacaucugcaucuga

SEQ ID NO: 166121 - RNA, 1701 nt, Artificial Sequence
  derived and/or modified sequence opt4 from hemagglutinin__InfluenzaA__ALE32117
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgacuucaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcgaguacaaggacuggauccuguggaucagcuucgccaucagcugcuuccugcugugcguggcccugcugggcuucaucaugugggccugccagaagggcaacaucagaugcaacaucugcaucuga

SEQ ID NO: 166122 - RNA, 1701 nt, Artificial Sequence; identical to SEQ ID NO: 165567
  derived and/or modified sequence opt4 from hemagglutinin__InfluenzaA__ALE32118

SEQ ID NO: 166123 - RNA, 1701 nt, Artificial Sequence; identical to SEQ ID NO: 155189
  derived and/or modified sequence opt4 from hemagglutinin__InfluenzaA__ALM06086

SEQ ID NO: 166124 - RNA, 1701 nt, Artificial Sequence; identical to SEQ ID NO: 162560
  derived and/or modified sequence opt4 from hemagglutinin__InfluenzaA__ALM06087

SEQ ID NO: 166125 - RNA, 1701 nt, Artificial Sequence
  derived and/or modified sequence opt4 from hemagglutinin__InfluenzaA__ALM06088
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166126 - RNA, 1701 nt, Artificial Sequence; identical to SEQ ID NO: 162560
  derived and/or modified sequence opt4 from hemagglutinin__InfluenzaA__ALM06089

SEQ ID NO: 166127 - RNA, 1701 nt, Artificial Sequence
  derived and/or modified sequence opt4 from hemagglutinin__InfluenzaA__ALN39661
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 166128 - RNA, 1701 nt, Artificial Sequence; identical to SEQ ID NO: 165494
  derived and/or modified sequence opt4 from hemagglutinin__InfluenzaA__ALN39662

SEQ ID NO: 166129 - RNA, 1701 nt, Artificial Sequence; identical to SEQ ID NO: 164961
  derived and/or modified sequence opt4 from hemagglutinin__InfluenzaA__ALN39663

SEQ ID NO: 166130 - RNA, 1701 nt, Artificial Sequence
  derived and/or modified sequence opt4 from hemagglutinin__InfluenzaA__ALN39664
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagcccagcggcagagugaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166131 - RNA, 1701 nt, Artificial Sequence; identical to SEQ ID NO: 164961
  derived and/or modified sequence opt4 from hemagglutinin__InfluenzaA__ALN39665

SEQ ID NO: 166132 - RNA, 1701 nt, Artificial Sequence; identical to SEQ ID NO: 165567
  derived and/or modified sequence opt4 from hemagglutinin__InfluenzaA__ALN39666

SEQ ID NO: 166133 - RNA, 1701 nt, Artificial Sequence
  derived and/or modified sequence opt4 from hemagglutinin__InfluenzaA__ALN39667
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugacccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagaaacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166134 - RNA, 1701 nt, Artificial Sequence; identical to SEQ ID NO: 166036
  derived and/or modified sequence opt4 from hemagglutinin__InfluenzaA__ALN39668

SEQ ID NO: 166135 - RNA, 1701 nt, Artificial Sequence
  derived and/or modified sequence opt4 from hemagglutinin__InfluenzaA__ALN39669
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagcugagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166136 - RNA, 1701 nt, Artificial Sequence; identical to SEQ ID NO: 164961
  derived and/or modified sequence opt4 from hemagglutinin__InfluenzaA__ALN39670

SEQ ID NO: 166137 - RNA, 1701 nt, Artificial Sequence
  derived and/or modified sequence opt4 from hemagglutinin__InfluenzaA__ALN39671
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166138 - RNA, 1701 nt, Artificial Sequence; identical to SEQ ID NO: 164961
  derived and/or modified sequence opt4 from hemagglutinin__InfluenzaA__ALN39672

SEQ ID NO: 166139 - RNA, 1701 nt, Artificial Sequence
  derived and/or modified sequence opt4 from hemagglutinin__InfluenzaA__ALN39673
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccgacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166140 - RNA, 1701 nt, Artificial Sequence; identical to SEQ ID NO: 165501
  derived and/or modified sequence opt4 from hemagglutinin__InfluenzaA__ALN39674

SEQ ID NO: 166141 - RNA, 1701 nt, Artificial Sequence; identical to SEQ ID NO: 164961
  derived and/or modified sequence opt4 from hemagglutinin__InfluenzaA__ALN39675

SEQ ID NO: 166142 - RNA, 1701 nt, Artificial Sequence
  derived and/or modified sequence opt4 from hemagglutinin__InfluenzaA__ALN39676
augaagaccaucaucgcccugagcugcauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucagaaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagaacacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccagagcgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166143 - RNA, 1701 nt, Artificial Sequence
  derived and/or modified sequence opt4 from hemagglutinin__InfluenzaA__ALN39677
augaagaccaucaucgcccugggcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccacaagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacgccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166144 - RNA, 1701 nt, Artificial Sequence; identical to SEQ ID NO: 165848
  derived and/or modified sequence opt4 from hemagglutinin__InfluenzaA__ALN39678

SEQ ID NO: 166145 - RNA, 1701 nt, Artificial Sequence
  derived and/or modified sequence opt4 from hemagglutinin__InfluenzaA__ALN39679
augaagaccaucaucgcccugggcuacauccugugccugguguucgcccagaagauccccggcaacgacaacagcaccgccacccugugccugggccaccacgccgugcccaacggcaccguggugaagaccaucaccaacgacagaaucgaggugaccaacgccaccgagcuggugcagaacagcagcaucggcgagaucugcgacagcccccacaagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166146 - RNA, 1701 nt, Artificial Sequence; identical to SEQ ID NO: 165848
  derived and/or modified sequence opt4 from hemagglutinin__InfluenzaA__ALN39680

SEQ ID NO: 166147 - RNA, 1701 nt, Artificial Sequence; identical to SEQ ID NO: 165848
  derived and/or modified sequence opt4 from hemagglutinin__InfluenzaA__ALN39681

SEQ ID NO: 166148 - RNA, 1701 nt, Artificial Sequence; identical to SEQ ID NO: 165848
  derived and/or modified sequence opt4 from hemagglutinin__InfluenzaA__ALN39682

SEQ ID NO: 166149 - RNA, 1701 nt, Artificial Sequence; identical to SEQ ID NO: 165848
  derived and/or modified sequence opt4 from hemagglutinin__InfluenzaA__ALN39683

SEQ ID NO: 166150 - RNA, 1701 nt, Artificial Sequence; identical to SEQ ID NO: 165848
  derived and/or modified sequence opt4 from hemagglutinin__InfluenzaA__ALN39684

SEQ ID NO: 166151 - RNA, 1701 nt, Artificial Sequence; identical to SEQ ID NO: 165848
  derived and/or modified sequence opt4 from hemagglutinin__InfluenzaA__ALN39685

SEQ ID NO: 166152 - RNA, 1701 nt, Artificial Sequence
  derived and/or modified sequence opt4 from hemagglutinin__InfluenzaA__ALN39686
augaagaccaucaucgcccugggcuacauccugugccuggccuucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccacaagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacaccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166153 - RNA, 1701 nt, Artificial Sequence; identical to SEQ ID NO: 165848
  derived and/or modified sequence opt4 from hemagglutinin__InfluenzaA__ALN39687

SEQ ID NO: 166154 - RNA, 1701 nt, Artificial Sequence
  derived and/or modified sequence opt4 from hemagglutinin__InfluenzaA__ALN39688
augaagaccaucaucgcccugggcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccacaagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaucuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166155 - RNA, 1701 nt, Artificial Sequence
  derived and/or modified sequence opt4 from hemagglutinin__InfluenzaA__ALN39689
augaagaccaucaucgcccugggcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccacaagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugauccacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166156 - RNA, 1701 nt, Artificial Sequence
  derived and/or modified sequence opt4 from hemagglutinin__InfluenzaA__ALN39690
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaucuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166157 - RNA, 1701 nt, Artificial Sequence
  derived and/or modified sequence opt4 from hemagglutinin__InfluenzaA__ALN39691
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagcccagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166158 - RNA, 1701 nt, Artificial Sequence; identical to SEQ ID NO: 165848
  derived and/or modified sequence opt4 from hemagglutinin__InfluenzaA__ALN39692

SEQ ID NO: 166159 - RNA, 1701 nt, Artificial Sequence; identical to SEQ ID NO: 165848
  derived and/or modified sequence opt4 from hemagglutinin__InfluenzaA__ALN39693

SEQ ID NO: 166160 - RNA, 1701 nt, Artificial Sequence; identical to SEQ ID NO: 165848
  derived and/or modified sequence opt4 from hemagglutinin__InfluenzaA__ALN39694

SEQ ID NO: 166161 - RNA, 1701 nt, Artificial Sequence; identical to SEQ ID NO: 165848
  derived and/or modified sequence opt4 from hemagglutinin__InfluenzaA__ALN39695

SEQ ID NO: 166162 - RNA, 1701 nt, Artificial Sequence; identical to SEQ ID NO: 165848
  derived and/or modified sequence opt4 from hemagglutinin__InfluenzaA__ALN39696

SEQ ID NO: 166163 - RNA, 1701 nt, Artificial Sequence; identical to SEQ ID NO: 165518
  derived and/or modified sequence opt4 from hemagglutinin__InfluenzaA__ALN39697

SEQ ID NO: 166164 - RNA, 1701 nt, Artificial Sequence
  derived and/or modified sequence opt4 from hemagglutinin__InfluenzaA__ALN39698
augaagaccaucaucgcccugagccacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaugggcagcaucagaaacggcaccuacgaccacaacguguacagaaacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166165 - RNA, 1701 nt, Artificial Sequence
  derived and/or modified sequence opt4 from hemagglutinin__InfluenzaA__ALN39700
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucaagugcaacaucugcaucuga

SEQ ID NO: 166166 - RNA, 1701 nt, Artificial Sequence; identical to SEQ ID NO: 165567
  derived and/or modified sequence opt4 from hemagglutinin__InfluenzaA__ALN39701

SEQ ID NO: 166167 - RNA, 1701 nt, Artificial Sequence
  derived and/or modified sequence opt4 from hemagglutinin__InfluenzaA__ALN39702
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcagcaucugcaucuga

SEQ ID NO: 166168 - RNA, 1701 nt, Artificial Sequence
  derived and/or modified sequence opt4 from hemagglutinin__InfluenzaA__ALN39703
augaagaccaucaucgcccugagcuacauccugugccugguguucgcccagaagauccccggcaacgacgacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166169 - RNA, 1701 nt, Artificial Sequence; identical to SEQ ID NO: 165567
  derived and/or modified sequence opt4 from hemagglutinin__InfluenzaA__ALN39704

SEQ ID NO: 166170 - RNA, 1701 nt, Artificial Sequence; identical to SEQ ID NO: 164961
  derived and/or modified sequence opt4 from hemagglutinin__InfluenzaA__ALN39705

SEQ ID NO: 166171 - RNA, 1701 nt, Artificial Sequence
  derived and/or modified sequence opt4 from hemagglutinin__InfluenzaA__ALN39706
augaagaccaucaucgcccugagcuacauccugugccugguguucgcccagaagcugcccggcaacgacaacagcaccgccacccugugccugggccaccacgccgugcccaacggcaugaucgugaagaccaucaccaacgacagaaucgaggugaccaacgccaccgagcuggugcagaacagcagcaucggcgagaucugcgacagcccccaccagauccuggacggcaagaacugcacccugaucgacgcccugcugggcgacccccagugcgacgacuuccagaacaagagaugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166172 - RNA, 1701 nt, Artificial Sequence; identical to SEQ ID NO: 164961
  derived and/or modified sequence opt4 from hemagglutinin__InfluenzaA__ALN39707

SEQ ID NO: 166173 - RNA, 1701 nt, Artificial Sequence; identical to SEQ ID NO: 165567
  derived and/or modified sequence opt4 from hemagglutinin__InfluenzaA__ALN39708

SEQ ID NO: 166174 - RNA, 1701 nt, Artificial Sequence
  derived and/or modified sequence opt4 from hemagglutinin__InfluenzaA__ALN39709
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaugagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugacccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166175 - RNA, 1701 nt, Artificial Sequence; identical to SEQ ID NO: 165891
  derived and/or modified sequence opt4 from hemagglutinin__InfluenzaA__ALN39710

SEQ ID NO: 166176 - RNA, 1701 nt, Artificial Sequence; identical to SEQ ID NO: 165567
  derived and/or modified sequence opt4 from hemagglutinin__InfluenzaA__ALN39711

SEQ ID NO: 166177 - RNA, 1701 nt, Artificial Sequence; identical to SEQ ID NO: 164961
  derived and/or modified sequence opt4 from hemagglutinin__InfluenzaA__ALN39712

SEQ ID NO: 166178 - RNA, 1701 nt, Artificial Sequence
  derived and/or modified sequence opt4 from hemagglutinin__InfluenzaA__ALN39713
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166179 - RNA, 1701 nt, Artificial Sequence
  derived and/or modified sequence opt4 from hemagglutinin__InfluenzaA__ALN39714
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaccuuccuguacgcccagcccagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166180 - RNA, 1701 nt, Artificial Sequence; identical to SEQ ID NO: 165619
  derived and/or modified sequence opt4 from hemagglutinin__InfluenzaA__ALN39715

SEQ ID NO: 166181 - RNA, 1701 nt, Artificial Sequence; identical to SEQ ID NO: 164961
  derived and/or modified sequence opt4 from hemagglutinin__InfluenzaA__ALN39716

SEQ ID NO: 166182 - RNA, 1701 nt, Artificial Sequence; identical to SEQ ID NO: 164961
  derived and/or modified sequence opt4 from hemagglutinin__InfluenzaA__ALN39717

SEQ ID NO: 166183 - RNA, 1701 nt, Artificial Sequence; identical to SEQ ID NO: 165999
  derived and/or modified sequence opt4 from hemagglutinin__InfluenzaA__ALN39718

SEQ ID NO: 166184 - RNA, 1701 nt, Artificial Sequence; identical to SEQ ID NO: 164961
  derived and/or modified sequence opt4 from hemagglutinin__InfluenzaA__ALN39734

SEQ ID NO: 166185 - RNA, 1701 nt, Artificial Sequence
  derived and/or modified sequence opt4 from hemagglutinin__InfluenzaA__ALN39735
augaagaccaucaucgcccugagcuacauccugugccugguguucgcccagaagauccccggcaacgacaacagcaccgccacccugugccugggccaccacgccgugcccaacggcaccaucgugaagaccaucaccgacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166186 - RNA, 1701 nt, Artificial Sequence
  derived and/or modified sequence opt4 from hemagglutinin__InfluenzaA__ALN39736
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagcccagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaggcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccagaaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166187 - RNA, 1701 nt, Artificial Sequence; identical to SEQ ID NO: 165567
  derived and/or modified sequence opt4 from hemagglutinin__InfluenzaA__ALN39737

SEQ ID NO: 166188 - RNA, 1701 nt, Artificial Sequence
  derived and/or modified sequence opt4 from hemagglutinin__InfluenzaA__ALN39738
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccugugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166189 - RNA, 1701 nt, Artificial Sequence
  derived and/or modified sequence opt4 from hemagglutinin__InfluenzaA__ALN39739
augaagaccaucaucgcccugggcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccacaagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccuggacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166190 - RNA, 1701 nt, Artificial Sequence
  derived and/or modified sequence opt4 from hemagglutinin__InfluenzaA__ALN39740
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccgugcccaacaacgagcaguucgacaagcuguacaucuggggcgugcaccaccccggcaccgacaaggaccagaucuuccuguacgccagaagcagcggcagaaucaccgugagcaccaagagaagccagcaggccgugauccccaacaucggcuacagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166191 - RNA, 1701 nt, Artificial Sequence; identical to SEQ ID NO: 164961
  derived and/or modified sequence opt4 from hemagglutinin__InfluenzaA__ALN39741

SEQ ID NO: 166192 - RNA, 1701 nt, Artificial Sequence
  derived and/or modified sequence opt4 from hemagglutinin__InfluenzaA__ALN39742
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgacugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166193 - RNA, 1701 nt, Artificial Sequence
  derived and/or modified sequence opt4 from hemagglutinin__InfluenzaA__ALN39743
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaucuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166194 - RNA, 1701 nt, Artificial Sequence
  derived and/or modified sequence opt4 from hemagglutinin__InfluenzaA__ALN39744
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166195 - RNA, 1701 nt, Artificial Sequence
  derived and/or modified sequence opt4 from hemagglutinin__InfluenzaA__ALN39745
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166196 - RNA, 1701 nt, Artificial Sequence; identical to SEQ ID NO: 166194
  derived and/or modified sequence opt4 from hemagglutinin__InfluenzaA__ALN39746

SEQ ID NO: 166197 - RNA, 1701 nt, Artificial Sequence; identical to SEQ ID NO: 165889
  derived and/or modified sequence opt4 from hemagglutinin__InfluenzaA__ALN39747

SEQ ID NO: 166198 - RNA, 1701 nt, Artificial Sequence
  derived and/or modified sequence opt4 from hemagglutinin__InfluenzaA__ALN39748
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacgccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagauccugagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166199 - RNA, 1701 nt, Artificial Sequence
  derived and/or modified sequence opt4 from hemagglutinin__InfluenzaA__ALN39749
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagcccagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166200 - RNA, 1701 nt, Artificial Sequence; identical to SEQ ID NO: 164961
  derived and/or modified sequence opt4 from hemagglutinin__InfluenzaA__ALN39750

SEQ ID NO: 166201 - RNA, 1701 nt, Artificial Sequence; identical to SEQ ID NO: 164961
  derived and/or modified sequence opt4 from hemagglutinin__InfluenzaA__ALN39789

SEQ ID NO: 166202 - RNA, 1701 nt, Artificial Sequence; identical to SEQ ID NO: 165491
  derived and/or modified sequence opt4 from hemagglutinin__InfluenzaA__ALO75895

SEQ ID NO: 166203 - RNA, 1701 nt, Artificial Sequence
  derived and/or modified sequence opt4 from hemagglutinin__InfluenzaA__ALO75907
auggagaagaucgugcugcugcuggccaucgugagccuggugaagggcgaccagaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcugguuccugggcaacagaaugugcgacgaguucaucagagugcccgaguggagcuacaucguggagagagccaaccccgccaacgaccugugcuaccccggcaaccugaacgacuacgaggagcugaagcaccugcugagcagaaucaaccacuucgagaagacccugaucauccccaagagcagcuggcccaaccacaccagcagcggcgugagcgccgccugccccuaccagggcaugcccagcuucuucagaaacgugguguggcugaccaagaagaacgacgccuaccccaccaucaagaugagcuacaacaacaccuacagagaggaccugcugauccuguggggcauccaccacagcaacaacgccgccgagcagaccaaccuguacaagaaccccaccaccuacgugagcgugggcaccagcacccugaaccagagacuggagcccaagaucgccaccagaagccaggugaacggccagagaggcagaauggacuucuucuggaccauccugaagcccaacgacgccauccacuucgagagcaacggcaacuucaucgcccccgaguacgccuacaagaucgugaagaagggcgacagcaccaucaugaagagcgagauggaguacggccacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacagagagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccuguacagcgaggaggccagacugaagagagaggagaucagcggcgugaagcuggagagcaucggcaccuaccagauccugagcaacuacagcaccguggccagcagccuggcccuggccaucaucguggccggccugagccuguggaugugcagcaacggcagccugcagugcagaaucugcaucuga

SEQ ID NO: 166204 - RNA, 1701 nt, Artificial Sequence
  derived and/or modified sequence opt4 from hemagglutinin__InfluenzaA__ALO75919
auggagaagaucgugcugcugcuggccaucgugagccuggugaagggcgaccagaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcuggcugcacggcaacagaaugugcgacgaguucaucagagugcccgaguggagcuacaucguggagagagccaaccccgccaacgaccugugcuaccccggcaaccugaacgacuacgaggagcugaagcaccugcugagcagaaucaaccacuucgagaagacccugaucauccccaagagcagcuggcccaaccacaccagcagcggcgugagcgccgccugccccuaccagggcaugcccagcuucuucagaaacgugguguggcugaccaagaagaacgacgccuaccccaccaucaagaugagcuacaacaacaccuacagagaggaccugcugauccuguggggcauccaccacagcaacaacgccgccgagcagaccaaccuguacaagaaccccaccaccuacgugagcgugggcaccagcacccugaaccagagacuggagcccaagaucgccaccagaagccaggugaacggccagagaggcagaauggacuucuucuggaccauccugaagcccaacgacgccauccacuucgagagcaacggcaacuucaucgcccccgaguacgccuacaagaucgugaagaagggcgacagcaccaucaugaagagcgagauggaguacggccacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacagagagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccuguacagcgaggaggccagccugaagagagaggagaucagcggcgugaagcuggagagcaucggcaccuaccagauccugagcaucuacagcaccguggccagcagccuggcccuggccaucaucguggccggccugagccuguggaugugcagcaacggcagccugcagugcagaaucugcaucuga

SEQ ID NO: 166205 - RNA, 1683 nt, Artificial Sequence
  derived and/or modified sequence opt4 from hemagglutinin__InfluenzaA__ALT20080
auggagaccgugagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugagccuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacgacggcaccagcaccgccugcagcggcagcuucuacagaagcaugagauggcugaccagaaagaacggcgacuaccccauccaggacgcccaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguucggccacauccugagcggcgagagccacggcagaauccugaagaccaaccugaagagaggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 166206 - RNA, 1701 nt, Artificial Sequence
  derived and/or modified sequence opt4 from hemagglutinin__InfluenzaA__ALT66860
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaaccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaccagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166207 - RNA, 1701 nt, Artificial Sequence
  derived and/or modified sequence opt4 from hemagglutinin__InfluenzaA__AMA65391
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaaccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaccagacccaaggugagaggccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcuggugguguuccugggcgccaucagcuucuggaugugcagcaacggcagccugcagugcagaaucugcaucuga

SEQ ID NO: 166208 - RNA, 1701 nt, Artificial Sequence
  derived and/or modified sequence opt4 from hemagglutinin__InfluenzaA__AMA65393
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaaccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaccagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagccccguggccagcagccuggugcuggugguguuccugggcgccaucagcuucuggaugugcagcaacggcagccugcagugcagaaucugcaucuga

SEQ ID NO: 166209 - RNA, 1701 nt, Artificial Sequence
  derived and/or modified sequence opt4 from hemagglutinin__InfluenzaA__BAA02768
augaaggccaagcugcuggugcugcugugcgccuucaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcaucgccggcuggauccugggcaaccccgagugcgagagccuguucagcaaggagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacagaaaccugcuguggcugaccggcaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggaguaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcuacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 166210 - RNA, 1701 nt, Artificial Sequence
  derived and/or modified sequence opt4 from hemagglutinin__InfluenzaA__BAA02769
augaaggccaagcugcuggugcugcugugcgccuucaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcaucgccggcuggauccugggcaaccccgagugcgagagccuguucagcaaggagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacagaaaccugcuguggcugaccggcaagaacggccuguaccccaaccugagcaagagcuacgugaacaacaaggagaaggaggugcuggugcuguggggcgugcaccaccccagcaacaucagagaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaagggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggaguaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcuacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 166211 - RNA, 1689 nt, Artificial Sequence
  derived and/or modified sequence opt4 from hemagglutinin__InfluenzaA__BAC43764
auggccaucaucuaccugauccugcuguucaccgccgugagaggcgaccagaucugcaucggcuaccacgccaacaacagcaccgagaagguggacaccauccuggagagaaacgugaccgugacccacgccaagaacauccuggagaagacccacaacggcaagcugugcaagcugaacggcauccccccccuggagcugggcgacugcagcaucgccggcuggcugcugggcaaccccgagugcgacagacugcugaucgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccguggccaagggcagcuacaacaacaccagcggcgagcagaugcugaucaucuggggcgugcaccaccccaucgacgagaccgagcagaucacccuguaccagaacgugggcaccuacgugagcgugggcaccagcacccugaacaagagaagcacccccgagaucgccaccagacccaaggugaacggccugggcagcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcaguucagaaucugcaucuga

SEQ ID NO: 166212 - RNA, 1707 nt, Artificial Sequence
  derived and/or modified sequence opt4 from hemagglutinin__InfluenzaA__BAE07201
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcgacuucaacgacuacgaggagcugaagcaccugcugagcagaaucaaccacuucgagaagauccagaucauccccaagaacagcuggagcagccacgaggccagccugggcgugagcagcgccugccccuaccagggcaagagcagcuucuucagaaacgugguguggcugaucaagaagaacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagaacggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 166213 - RNA, 1701 nt, Artificial Sequence
  derived and/or modified sequence opt4 from hemagglutinin__InfluenzaA__BAH95823
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaagcacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166214 - RNA, 1701 nt, Artificial Sequence; identical to SEQ ID NO: 155176
  derived and/or modified sequence opt4 from hemagglutinin__InfluenzaA__BAH95824

SEQ ID NO: 166215 - RNA, 1707 nt, Artificial Sequence
  derived and/or modified sequence opt4 from hemagglutinin__InfluenzaA__BAJ07997
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcgacuucaacgacuacgaggagcugaagcaccugcugagcagaaucaaccacuucgagaagauccagaucauccccaagaacagcuggagcagccacgaggccagccugggcgugagcagcgccugccccuaccagggcaagagcagcuucuucagaaacgugguguggcugaucaagaagaacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 166216 - RNA, 1701 nt, Artificial Sequence
  derived and/or modified sequence opt4 from hemagglutinin__InfluenzaA__BAJ39949
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccaagcugcuggugcugcugaagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166217 - RNA, 1701 nt, Artificial Sequence
  derived and/or modified sequence opt4 from hemagglutinin__InfluenzaA__BAJ39950
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucgccgagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166218 - RNA, 1701 nt, Artificial Sequence
  derived and/or modified sequence opt4 from hemagglutinin__InfluenzaA__BAJ39951
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcuuccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166219 - RNA, 1701 nt, Artificial Sequence; identical to SEQ ID NO: 161792
  derived and/or modified sequence opt4 from hemagglutinin__InfluenzaA__BAJ39952

SEQ ID NO: 166220 - RNA, 1701 nt, Artificial Sequence
  derived and/or modified sequence opt4 from hemagglutinin__InfluenzaA__BAJ39953
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccaagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166221 - RNA, 1701 nt, Artificial Sequence; identical to SEQ ID NO: 161792
  derived and/or modified sequence opt4 from hemagglutinin__InfluenzaA__BAJ39954

SEQ ID NO: 166222 - RNA, 1701 nt, Artificial Sequence
  derived and/or modified sequence opt4 from hemagglutinin__InfluenzaA__BAJ39955
augaaggccauccugguggugcugcuguacaccuucgccaccgccaacgccgacacccugagcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaucagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcaagaucugcaucuga

SEQ ID NO: 166223 - RNA, 1701 nt, Artificial Sequence; identical to SEQ ID NO: 166217
  derived and/or modified sequence opt4 from hemagglutinin__InfluenzaA__BAJ39956

SEQ ID NO: 166224 - RNA, 1701 nt, Artificial Sequence; identical to SEQ ID NO: 161792
  derived and/or modified sequence opt4 from hemagglutinin__InfluenzaA__BAJ39957

SEQ ID NO: 166225 - RNA, 1701 nt, Artificial Sequence
  derived and/or modified sequence opt4 from hemagglutinin__InfluenzaA__BAJ39958
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcaaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166226 - RNA, 1701 nt, Artificial Sequence
  derived and/or modified sequence opt4 from hemagglutinin__InfluenzaA__BAJ39959
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccuucauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcaaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166227 - RNA, 1701 nt, Artificial Sequence; identical to SEQ ID NO: 155189
  derived and/or modified sequence opt4 from hemagglutinin__InfluenzaA__BAJ39960

SEQ ID NO: 166228 - RNA, 1701 nt, Artificial Sequence; identical to SEQ ID NO: 155818
  derived and/or modified sequence opt4 from hemagglutinin__InfluenzaA__BAJ39961

SEQ ID NO: 166229 - RNA, 1701 nt, Artificial Sequence
  derived and/or modified sequence opt4 from hemagglutinin__InfluenzaA__BAJ39962
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucgccgagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaccuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccuucauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcaaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166230 - RNA, 1701 nt, Artificial Sequence; identical to SEQ ID NO: 155189
  derived and/or modified sequence opt4 from hemagglutinin__InfluenzaA__BAJ39963

SEQ ID NO: 166231 - RNA, 1701 nt, Artificial Sequence; identical to SEQ ID NO: 161792
  derived and/or modified sequence opt4 from hemagglutinin__InfluenzaA__BAJ39964

SEQ ID NO: 166232 - RNA, 1701 nt, Artificial Sequence; identical to SEQ ID NO: 155189
  derived and/or modified sequence opt4 from hemagglutinin__InfluenzaA__BAJ39965

SEQ ID NO: 166233 - RNA, 1701 nt, Artificial Sequence; identical to SEQ ID NO: 155189
  derived and/or modified sequence opt4 from hemagglutinin__InfluenzaA__BAJ39966

SEQ ID NO: 166234 - RNA, 1701 nt, Artificial Sequence
  derived and/or modified sequence opt4 from hemagglutinin__InfluenzaA__BAJ39967
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagcugcugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcgacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgcccugggcaaggaguucaaccaccuggagaagaagaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166235 - RNA, 1701 nt, Artificial Sequence; identical to SEQ ID NO: 160717
  derived and/or modified sequence opt4 from hemagglutinin__InfluenzaA__BAJ39968

SEQ ID NO: 166236 - RNA, 1701 nt, Artificial Sequence; identical to SEQ ID NO: 161792
  derived and/or modified sequence opt4 from hemagglutinin__InfluenzaA__BAJ39969

SEQ ID NO: 166237 - RNA, 1701 nt, Artificial Sequence; identical to SEQ ID NO: 155189
  derived and/or modified sequence opt4 from hemagglutinin__InfluenzaA__BAJ39970

SEQ ID NO: 166238 - RNA, 1701 nt, Artificial Sequence; identical to SEQ ID NO: 155189
  derived and/or modified sequence opt4 from hemagglutinin__InfluenzaA__BAJ39971

SEQ ID NO: 166239 - RNA, 1701 nt, Artificial Sequence; identical to SEQ ID NO: 155818
  derived and/or modified sequence opt4 from hemagglutinin__InfluenzaA__BAJ39972

SEQ ID NO: 166240 - RNA, 1701 nt, Artificial Sequence
  derived and/or modified sequence opt4 from hemagglutinin__InfluenzaA__BAJ39973
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166241 - RNA, 1701 nt, Artificial Sequence; identical to SEQ ID NO: 155189
  derived and/or modified sequence opt4 from hemagglutinin__InfluenzaA__BAJ39974

SEQ ID NO: 166242 - RNA, 1701 nt, Artificial Sequence; identical to SEQ ID NO: 155758
  derived and/or modified sequence opt4 from hemagglutinin__InfluenzaA__BAJ39975

SEQ ID NO: 166243 - RNA, 1701 nt, Artificial Sequence
  derived and/or modified sequence opt4 from hemagglutinin__InfluenzaA__BAJ39976
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacgagaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucaacuucuggaugugcagcaacggcagccugcagugcagaaucugcaucuga

SEQ ID NO: 166244 - RNA, 1701 nt, Artificial Sequence; identical to SEQ ID NO: 155189
  derived and/or modified sequence opt4 from hemagglutinin__InfluenzaA__BAJ39977

SEQ ID NO: 166245 - RNA, 1701 nt, Artificial Sequence
  derived and/or modified sequence opt4 from hemagglutinin__InfluenzaA__BAJ39978
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166246 - RNA, 1701 nt, Artificial Sequence
  derived and/or modified sequence opt4 from hemagglutinin__InfluenzaA__BAJ39979
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagcugcugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcgacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaauggacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaacagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166247 - RNA, 1701 nt, Artificial Sequence; identical to SEQ ID NO: 161792
  derived and/or modified sequence opt4 from hemagglutinin__InfluenzaA__BAJ39980

SEQ ID NO: 166248 - RNA, 1701 nt, Artificial Sequence
  derived and/or modified sequence opt4 from hemagglutinin__InfluenzaA__BAJ39981
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugcagcaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcaaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166249 - RNA, 1701 nt, Artificial Sequence
  derived and/or modified sequence opt4 from hemagglutinin__InfluenzaA__BAJ39982
augaaggccauccugguggugcugcuguacaccuucgccaccgccaacgccgccacccugugcaucggcuaccacgccaacaacagcaccgacaccguggacacccugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166250 - RNA, 1701 nt, Artificial Sequence; identical to SEQ ID NO: 166217
  derived and/or modified sequence opt4 from hemagglutinin__InfluenzaA__BAJ39983

SEQ ID NO: 166251 - RNA, 1701 nt, Artificial Sequence
  derived and/or modified sequence opt4 from hemagglutinin__InfluenzaA__BAJ39984
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagcugcugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166252 - RNA, 1701 nt, Artificial Sequence; identical to SEQ ID NO: 155189
  derived and/or modified sequence opt4 from hemagglutinin__InfluenzaA__BAJ39985

SEQ ID NO: 166253 - RNA, 1701 nt, Artificial Sequence
  derived and/or modified sequence opt4 from hemagglutinin__InfluenzaA__BAJ39987
augaagaccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcaaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166254 - RNA, 1701 nt, Artificial Sequence
  derived and/or modified sequence opt4 from hemagglutinin__InfluenzaA__BAJ39988
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagcaucuaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugcagcaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166255 - RNA, 1701 nt, Artificial Sequence; identical to SEQ ID NO: 156503
  derived and/or modified sequence opt4 from hemagglutinin__InfluenzaA__BAJ39989

SEQ ID NO: 166256 - RNA, 1701 nt, Artificial Sequence; identical to SEQ ID NO: 155189
  derived and/or modified sequence opt4 from hemagglutinin__InfluenzaA__BAJ39990

SEQ ID NO: 166257 - RNA, 1701 nt, Artificial Sequence; identical to SEQ ID NO: 155189
  derived and/or modified sequence opt4 from hemagglutinin__InfluenzaA__BAJ39993

SEQ ID NO: 166258 - RNA, 1701 nt, Artificial Sequence
  derived and/or modified sequence opt4 from hemagglutinin__InfluenzaA__BAJ39994
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaccaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugccuggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166259 - RNA, 1701 nt, Artificial Sequence; identical to SEQ ID NO: 155189
  derived and/or modified sequence opt4 from hemagglutinin__InfluenzaA__BAJ39996

SEQ ID NO: 166260 - RNA, 1701 nt, Artificial Sequence
  derived and/or modified sequence opt4 from hemagglutinin__InfluenzaA__BAJ39997
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaccaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166261 - RNA, 1701 nt, Artificial Sequence; identical to SEQ ID NO: 155189
  derived and/or modified sequence opt4 from hemagglutinin__InfluenzaA__BAJ39998

SEQ ID NO: 166262 - RNA, 1701 nt, Artificial Sequence
  derived and/or modified sequence opt4 from hemagglutinin__InfluenzaA__BAJ39999
augaaggccauccugguggugcugcuguacaccuucgccaccgccaacgccgacacccugugcaucggcuaccacgccaacaacagcaccgacaccguggacaccgugcuggagagaaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166263 - RNA, 1701 nt, Artificial Sequence
  derived and/or modified sequence opt4 from hemagglutinin__InfluenzaA__BAJ40000
augaagaccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166264 - RNA, 1701 nt, Artificial Sequence; identical to SEQ ID NO: 160199
  derived and/or modified sequence opt4 from hemagglutinin__InfluenzaA__BAJ40001

SEQ ID NO: 166265 - RNA, 1701 nt, Artificial Sequence; identical to SEQ ID NO: 155189
  derived and/or modified sequence opt4 from hemagglutinin__InfluenzaA__BAJ40002

SEQ ID NO: 166266 - RNA, 1701 nt, Artificial Sequence; identical to SEQ ID NO: 160199
  derived and/or modified sequence opt4 from hemagglutinin__InfluenzaA__BAJ40003

SEQ ID NO: 166267 - RNA, 1701 nt, Artificial Sequence
  derived and/or modified sequence opt4 from hemagglutinin__InfluenzaA__BAJ40004
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgagaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166268 - RNA, 1701 nt, Artificial Sequence
  derived and/or modified sequence opt4 from hemagglutinin__InfluenzaA__BAJ40006
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcagagaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166269 - RNA, 1701 nt, Artificial Sequence; identical to SEQ ID NO: 155189
  derived and/or modified sequence opt4 from hemagglutinin__InfluenzaA__BAJ40007

SEQ ID NO: 166270 - RNA, 1701 nt, Artificial Sequence
  derived and/or modified sequence opt4 from hemagglutinin__InfluenzaA__BAJ40008
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaucgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166271 - RNA, 1701 nt, Artificial Sequence
  derived and/or modified sequence opt4 from hemagglutinin__InfluenzaA__BAJ40009
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcgacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaauggacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaacagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166272 - RNA, 1701 nt, Artificial Sequence
  derived and/or modified sequence opt4 from hemagglutinin__InfluenzaA__BAJ40010
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagcugcugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcgacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaauggacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166273 - RNA, 1701 nt, Artificial Sequence; identical to SEQ ID NO: 166262
  derived and/or modified sequence opt4 from hemagglutinin__InfluenzaA__BAJ40011

SEQ ID NO: 166274 - RNA, 1701 nt, Artificial Sequence
  derived and/or modified sequence opt4 from hemagglutinin__InfluenzaA__BAJ40012
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcaucaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166275 - RNA, 1701 nt, Artificial Sequence; identical to SEQ ID NO: 166262
  derived and/or modified sequence opt4 from hemagglutinin__InfluenzaA__BAJ40013

SEQ ID NO: 166276 - RNA, 1701 nt, Artificial Sequence; identical to SEQ ID NO: 166262
  derived and/or modified sequence opt4 from hemagglutinin__InfluenzaA__BAJ40014

SEQ ID NO: 166277 - RNA, 1701 nt, Artificial Sequence
  derived and/or modified sequence opt4 from hemagglutinin__InfluenzaA__BAJ40015
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaacaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166278 - RNA, 1701 nt, Artificial Sequence; identical to SEQ ID NO: 166262
  derived and/or modified sequence opt4 from hemagglutinin__InfluenzaA__BAJ40016

SEQ ID NO: 166279 - RNA, 1701 nt, Artificial Sequence
  derived and/or modified sequence opt4 from hemagglutinin__InfluenzaA__BAJ40017
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaaggccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166280 - RNA, 1701 nt, Artificial Sequence; identical to SEQ ID NO: 156353
  derived and/or modified sequence opt4 from hemagglutinin__InfluenzaA__BAJ40018

SEQ ID NO: 166281 - RNA, 1701 nt, Artificial Sequence; identical to SEQ ID NO: 166268
  derived and/or modified sequence opt4 from hemagglutinin__InfluenzaA__BAJ40019

SEQ ID NO: 166282 - RNA, 1701 nt, Artificial Sequence; identical to SEQ ID NO: 166268
  derived and/or modified sequence opt4 from hemagglutinin__InfluenzaA__BAJ40020

SEQ ID NO: 166283 - RNA, 1701 nt, Artificial Sequence
  derived and/or modified sequence opt4 from hemagglutinin__InfluenzaA__BAJ40021
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgagaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166284 - RNA, 1701 nt, Artificial Sequence; identical to SEQ ID NO: 156353
  derived and/or modified sequence opt4 from hemagglutinin__InfluenzaA__BAJ40023

SEQ ID NO: 166285 - RNA, 1701 nt, Artificial Sequence
  derived and/or modified sequence opt4 from hemagglutinin__InfluenzaA__BAJ40024
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166286 - RNA, 1701 nt, Artificial Sequence; identical to SEQ ID NO: 166262
  derived and/or modified sequence opt4 from hemagglutinin__InfluenzaA__BAJ40025

SEQ ID NO: 166287 - RNA, 1701 nt, Artificial Sequence; identical to SEQ ID NO: 156353
  derived and/or modified sequence opt4 from hemagglutinin__InfluenzaA__BAJ40026

SEQ ID NO: 166288 - RNA, 1701 nt, Artificial Sequence
  derived and/or modified sequence opt4 from hemagglutinin__InfluenzaA__BAJ40027
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgagaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166289 - RNA, 1701 nt, Artificial Sequence
  derived and/or modified sequence opt4 from hemagglutinin__InfluenzaA__BAJ40028
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccgccuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166290 - RNA, 1701 nt, Artificial Sequence; identical to SEQ ID NO: 166262
  derived and/or modified sequence opt4 from hemagglutinin__InfluenzaA__BAJ40029

SEQ ID NO: 166291 - RNA, 1701 nt, Artificial Sequence
  derived and/or modified sequence opt4 from hemagglutinin__InfluenzaA__BAJ40030
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugaaggagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcagagaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166292 - RNA, 1701 nt, Artificial Sequence; identical to SEQ ID NO: 155189
  derived and/or modified sequence opt4 from hemagglutinin__InfluenzaA__BAJ40031

SEQ ID NO: 166293 - RNA, 1701 nt, Artificial Sequence; identical to SEQ ID NO: 166262
  derived and/or modified sequence opt4 from hemagglutinin__InfluenzaA__BAJ40032

SEQ ID NO: 166294 - RNA, 1701 nt, Artificial Sequence; identical to SEQ ID NO: 166291
  derived and/or modified sequence opt4 from hemagglutinin__InfluenzaA__BAJ40033

SEQ ID NO: 166295 - RNA, 1701 nt, Artificial Sequence
  derived and/or modified sequence opt4 from hemagglutinin__InfluenzaA__BAJ40034
augaaggccauccugguggugcugcuguacaccuucgccaccgccaacgccgacacccugugcaucggcuaccacgccaacaacagcaccgacaccguggacaccgugcuggagagaaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166296 - RNA, 1701 nt, Artificial Sequence
  derived and/or modified sequence opt4 from hemagglutinin__InfluenzaA__BAJ40035
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaaguucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166297 - RNA, 1701 nt, Artificial Sequence
  derived and/or modified sequence opt4 from hemagglutinin__InfluenzaA__BAJ40036
augaaggccauccugguggugcugaucuacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggaccaucguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166298 - RNA, 1701 nt, Artificial Sequence; identical to SEQ ID NO: 161792
  derived and/or modified sequence opt4 from hemagglutinin__InfluenzaA__BAJ40037

SEQ ID NO: 166299 - RNA, 1701 nt, Artificial Sequence
  derived and/or modified sequence opt4 from hemagglutinin__InfluenzaA__BAJ40038
augaaggccauccugcuggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggaccaucguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166300 - RNA, 1701 nt, Artificial Sequence; identical to SEQ ID NO: 155189
  derived and/or modified sequence opt4 from hemagglutinin__InfluenzaA__BAJ40039

SEQ ID NO: 166301 - RNA, 1701 nt, Artificial Sequence
  derived and/or modified sequence opt4 from hemagglutinin__InfluenzaA__BAJ40040
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcagagaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcuacggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166302 - RNA, 1701 nt, Artificial Sequence; identical to SEQ ID NO: 161792
  derived and/or modified sequence opt4 from hemagglutinin__InfluenzaA__BAJ40041

SEQ ID NO: 166303 - RNA, 1701 nt, Artificial Sequence
  derived and/or modified sequence opt4 from hemagglutinin__InfluenzaA__BAJ40042
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugaaggagccccugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcagagaggugcuggugcuguggggcauccaccaccccagcaccagcgccgacagacagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166304 - RNA, 1701 nt, Artificial Sequence; identical to SEQ ID NO: 161792
  derived and/or modified sequence opt4 from hemagglutinin__InfluenzaA__BAJ40043

SEQ ID NO: 166305 - RNA, 1701 nt, Artificial Sequence
  derived and/or modified sequence opt4 from hemagglutinin__InfluenzaA__BAJ40044
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcagaaggagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaucaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166306 - RNA, 1701 nt, Artificial Sequence; identical to SEQ ID NO: 166268
  derived and/or modified sequence opt4 from hemagglutinin__InfluenzaA__BAJ40045

SEQ ID NO: 166307 - RNA, 1701 nt, Artificial Sequence
  derived and/or modified sequence opt4 from hemagglutinin__InfluenzaA__BAJ40046
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcagaugcaacaucgccggcuggauccugggcaaccccgagugcgagagccugagcaccgccagcagcuggagcuacaucguggagaccagcaucagcgacaacggcaccugcuaccccggcgacuucaucgacuacgaggagcugaaggagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagaagaucgagaaccugaacaagaagguggacgacggcuuccuggacaucuggaccuacaacgccaagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166308 - RNA, 1701 nt, Artificial Sequence; identical to SEQ ID NO: 166291
  derived and/or modified sequence opt4 from hemagglutinin__InfluenzaA__BAJ40047

SEQ ID NO: 166309 - RNA, 1701 nt, Artificial Sequence; identical to SEQ ID NO: 166262
  derived and/or modified sequence opt4 from hemagglutinin__InfluenzaA__BAJ40048

SEQ ID NO: 166310 - RNA, 1701 nt, Artificial Sequence
  derived and/or modified sequence opt4 from hemagglutinin__InfluenzaA__BAJ40050
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugaaggagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166311 - RNA, 1701 nt, Artificial Sequence; identical to SEQ ID NO: 156353
  derived and/or modified sequence opt4 from hemagglutinin__InfluenzaA__BAJ40051

SEQ ID NO: 166312 - RNA, 1701 nt, Artificial Sequence
  derived and/or modified sequence opt4 from hemagglutinin__InfluenzaA__BAJ40052
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcagagaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166313 - RNA, 1701 nt, Artificial Sequence
  derived and/or modified sequence opt4 from hemagglutinin__InfluenzaA__BAJ40053
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166314 - RNA, 1701 nt, Artificial Sequence; identical to SEQ ID NO: 156353
  derived and/or modified sequence opt4 from hemagglutinin__InfluenzaA__BAJ40054

SEQ ID NO: 166315 - RNA, 1701 nt, Artificial Sequence
  derived and/or modified sequence opt4 from hemagglutinin__InfluenzaA__BAJ40055
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaucugccagacccccaagggcgccaucaacaccagccugcccuuccagaacauccaccccaucaccaucggcaagugccccaaguacgugaagagcaccaagcugagacuggccaccggccugagaaacgugcccagcgugcagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166316 - RNA, 1701 nt, Artificial Sequence
  derived and/or modified sequence opt4 from hemagglutinin__InfluenzaA__BAJ40056
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagcugcugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcaggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagacacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagccccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcuacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166317 - RNA, 1701 nt, Artificial Sequence
  derived and/or modified sequence opt4 from hemagglutinin__InfluenzaA__BAJ40057
augaaggccauccugguggugcugcuguacaccuucgccaccgccaacgccgacacccugugcaucggcuaccacgccaacaacagcaccgacaccguggacaccgugcuggagagaaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacgaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166318 - RNA, 1701 nt, Artificial Sequence; identical to SEQ ID NO: 161792
  derived and/or modified sequence opt4 from hemagglutinin__InfluenzaA__BAJ40058

SEQ ID NO: 166319 - RNA, 1701 nt, Artificial Sequence; identical to SEQ ID NO: 166262
  derived and/or modified sequence opt4 from hemagglutinin__InfluenzaA__BAJ40059

SEQ ID NO: 166320 - RNA, 1701 nt, Artificial Sequence; identical to SEQ ID NO: 156353
  derived and/or modified sequence opt4 from hemagglutinin__InfluenzaA__BAJ40060

SEQ ID NO: 166321 - RNA, 1701 nt, Artificial Sequence
  derived and/or modified sequence opt4 from hemagglutinin__InfluenzaA__BAJ40061
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaaggccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166322 - RNA, 1701 nt, Artificial Sequence
  derived and/or modified sequence opt4 from hemagglutinin__InfluenzaA__BAJ40062
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagaagaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcaagaucugcaucuga

SEQ ID NO: 166323 - RNA, 1701 nt, Artificial Sequence; identical to SEQ ID NO: 166321
  derived and/or modified sequence opt4 from hemagglutinin__InfluenzaA__BAJ40063

SEQ ID NO: 166324 - RNA, 1701 nt, Artificial Sequence; identical to SEQ ID NO: 161792
  derived and/or modified sequence opt4 from hemagglutinin__InfluenzaA__BAJ40064

SEQ ID NO: 166325 - RNA, 1707 nt, Artificial Sequence
  derived and/or modified sequence opt4 from hemagglutinin__InfluenzaA__BAK23398
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgugaacgaccugugcuaccccggcaacuucaacgacuacgaggagcugaagcaccugcugagcagaaucaaccacuucgagaagauccagaucuuccccaagagcagcuggagcgaccacgaggccagcagcggcgugagcagcgccugccccuaccagggcagaagcagcuucuucagaaacgugguguggcuggugaagaaggacaacgccuaccccaccaucaagaagagcuacaacaacaccaaccaggaggaccugcugauccuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaaucgaguucuucuggaccauccugaagagcaacgacgugaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagccccagaggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugaagaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugauggccggccuguuccuguggaugugcagcaacggcagccugcagugcagaaucugcaucuga

SEQ ID NO: 166326 - RNA, 1707 nt, Artificial Sequence
  derived and/or modified sequence opt4 from hemagglutinin__InfluenzaA__BAK23400
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcgacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccacaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcagcagacuggugcuggccaccggccugagaaacagcccccagggcaagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagagagccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccuguuccuguggaugugcagcaacggcagccugcagugcagaaucugcaucuga

SEQ ID NO: 166327 - RNA, 1707 nt, Artificial Sequence
  derived and/or modified sequence opt4 from hemagglutinin__InfluenzaA__BAK23401
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugagcgaguggagcuacaucguggagaagaucaaccccgccaacgaccugugcuaccccggcaacuucaacaacuacgaggagcugaagcaccugcugagcagaaucaacagauucgagaagauccagaucauccccaagagcagcuggcccgaccacgaggccagccugggcgugagcagcgccugccccuaccagggcggccccagcuucuacagaaacgugguguggcugaucaagaagaacaacaccuaccccaucaucaagaagagcuaccacaacaccaaccaggaggaccugcuggugcuguggggcauccaccaccccaacgacgaggaggagcagaccagaaucuacaagaaccccaccaccuacaucagcgugggcaccagcacccugaaccagagacuggugcccaagaucgccaccagaagcaaggugaacggccagagcggcagaguggaguucuucuggaccauccugaagagcaacgacaccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacauccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 166328 - RNA, 1707 nt, Artificial Sequence
  derived and/or modified sequence opt4 from hemagglutinin__InfluenzaA__BAK23402
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcaaccacgaggccagcagcggcgugagcagcgccugccccuaccagggcagaagcagcuucuucagaaacgugguguggcugaucaagaaggacaacgccuaccccaccaucaagaucagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacacccacccccugaccaucggcgagugccccaaguacgugaagagcaacagacuggugcuggccaccggccugagaaacagcccccacggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 166329 - RNA, 1707 nt, Artificial Sequence
  derived and/or modified sequence opt4 from hemagglutinin__InfluenzaA__BAK23403
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcaaccacgaggccagcagcggcgugagcagcgccugccccuaccagggcagaagcagcuucuucagaaacgugguguggcugaucaagaaggacaacgccuaccccaccaucaagaucagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 166330 - RNA, 1707 nt, Artificial Sequence
  derived and/or modified sequence opt4 from hemagglutinin__InfluenzaA__BAK23404
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 166331 - RNA, 1707 nt, Artificial Sequence; identical to SEQ ID NO: 166330
  derived and/or modified sequence opt4 from hemagglutinin__InfluenzaA__BAK23405

SEQ ID NO: 166332 - RNA, 1707 nt, Artificial Sequence
  derived and/or modified sequence opt4 from hemagglutinin__InfluenzaA__BAK23406
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgugaacgaccugugcuaccccggcaacuucaacgacuacgaggagcugaagcaccugcugagcagaaucaaccacuucgagaagauccagaucuuccccaagagcagcuggagcgaccacgaggccagcagcggcgugagcagcgccugccccuaccagggcagaagcagcuucuucagaaacgugguguggcuggugaagaaggacaacgccuaccccaccaucaagaagagcuacaacaacaccaaccaggaggaccugcugauccuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaaucgaguucuucuggaccauccugaagagcaacgacgugaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugaagaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugauggccggccuguuccuguggaugugcagcaacggcagccugcagugcagaaucugcaucuga

SEQ ID NO: 166333 - RNA, 1707 nt, Artificial Sequence
  derived and/or modified sequence opt4 from hemagglutinin__InfluenzaA__BAK23407
auggagaagaucgugcugcugcuggccaucgugagccuggugaagagcggccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugagcgaguggagcuacaucguggagaagaucaaccccgccaacgaccugugcuaccccggcaacuucaacaacuacgaggagcugaagcaccugcugagcagaaucaacagauucgagaagauccagaucauccccaagagcagcuggcccgaccacgaggccagccugggcgugagcgccgccugccccuaccagggcggccccagcuucuacagaaacgugguguggcugaucaagaagaacaacaccuaccccaccaucgagaagagcuaccacaacaccaaccaggaggaccugcuggugcuguggggcauccaccaccccaacgacgaggccgagcagaccagaaucuacaagaaccccaccaccuacaucagcgugggcaccagcacccugaaccagagacuggugcccaagaucgccaccagaagcaaggugaacggccagagcggcagaguggaguucuucuggaccauccugaagagcaacgacaccaucaacuucgagagcaacggcaacuucaucgcccccgagaacgccuacaagaucgugaagaagggcgacagcaccaucaugaagagcgagcuggaguacggcaacugcaacaccagaugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 166334 - RNA, 1707 nt, Artificial Sequence
  derived and/or modified sequence opt4 from hemagglutinin__InfluenzaA__BAK23408
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccccaacgugagcgaguggagcuacaucguggagaagaucaaccccgccaacgaccugugcuaccccggcaacuucaacaacuacgaggagcugaagcaccugcugagcagaaucaacagauucgagaagauccagaucauccccaagagcagcuggcccgaccacgaggccagccugggcgugagcagcgccugccaguaccagggcggccccagcuucuacagaaacgugguguggcugaucaagaaggacaacgccuaccccaccaucaagaagagcuaccacaacaccaacaaggaggaccugcuggugcuguggggcauccaccaccccaacaacgaggaggagcagaccaagcuguaccagaaccccaccaccuacaucagcgugggcaccagcacccugaaccagagacuggugcccaagaucgccaccagaagcaaggugaacggccagagcggcagaguggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacuacaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcaaggaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 166335 - RNA, 1707 nt, Artificial Sequence
  derived and/or modified sequence opt4 from hemagglutinin__InfluenzaA__BAK23411
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugagcgaguggagcuacaucguggagaagaucaaccccgccaacgaccugugcuaccccggcaacuucaacaacuacgaggagcugaagcaccugcugagcagaaucaacagauucgagaagauccagaucauccccaagagcagcuggcccgaccacgaggccagccugggcgugagcagcgccugccaguaccagggcggccccagcuucuacagaaacgugguguggcugaucaagaaggacaacgccuaccccaccaucaagaagagcuaccacaacaccaacaaggaggaccugcuggugcuguggggcauccaccaccccaacaacgaggaggagcagaccaagcuguaccagaaccccaccaccuacaucagcgugggcaccagcacccugaaccagagacuggugcccaagaucgccaccagaagcaaggugaacggccagagcggcagaguggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcaaggaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 166336 - RNA, 1707 nt, Artificial Sequence
  derived and/or modified sequence opt4 from hemagglutinin__InfluenzaA__BAK23412
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaagggcaagcugugcgaccuggacggcgugaagccccugauccugagagacugcagcguggccggcuggcugcugggcaaccccaugugcgacgaguuccugaacgugagcgaguggagcuacaucguggagaagaucaaccccgccaacgaccugugcuaccccggcaacuucaacaacuacgaggagcugaagcaccugcugagcagaaucaacagauucgagaagauccagaucauccccaagagcagcuggcccgaccacgaggccagccugggcgugagcagcgccugccaguaccagggcggccccagcuucuacagaaacgugguguggcugaucaagaaggacaacaccuaccccaccaucaagaagagcuaccacaacaccaacaaggaggaccugcuggugcuguggggcauccaccaccccaacaacgaggaggagcagaccaagcuguaccagaaccccaccaccuacaucagcgugggcaccagcacccugaaccagagacuggugcccaagaucgccaccagaagcaaggugaacggccagagcggcagaguggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcaaggaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaccggcaccuaccagauccugagcaucuacagcaccguggccagcagccuggcccuggccaucaugguggccggccuguuccuguggaugugcagcaacggcagccugcagugcagaaucugcaucuga

SEQ ID NO: 166337 - RNA, 1707 nt, Artificial Sequence
  derived and/or modified sequence opt4 from hemagglutinin__InfluenzaA__BAK23413
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugagcgaguggagcuacaucguggagaagaucaaccccgccaacgaccugugcuaccccggcaacuucaacaacuacgaggagcugaagcaccugcugagcagaaucaacagauucgagaagauccagaucauccccaagagcagcuggcccgaccacgaggccagccugggcgugagcagcgccugccaguaccagggcggccccagcuucuacagaaacgugguguggcugaucaagaaggacaacaccuaccccaccaucaagaagagcuaccacaacaccaacaaggaggaccugcuggugcuguggggcauccaccaccccaacaacgaggaggagcagaccaagcuguaccagaaccccaccaccuacaucagcgugggcaccagcacccugaaccagagacuggugcccaagaucgccaccagaagcaaggugaacggccagagcggcagaguggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcaaggaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 166338 - RNA, 1707 nt, Artificial Sequence; identical to SEQ ID NO: 166335
  derived and/or modified sequence opt4 from hemagglutinin__InfluenzaA__BAK23414

SEQ ID NO: 166339 - RNA, 1698 nt, Artificial Sequence
  derived and/or modified sequence opt4 from hemagglutinin__InfluenzaA__BAM65746
auggaggugaagcugcuggugcugcugugcaccuucaccgccaccuacgccgacaccaucugcaucggcuaccacgccaacaacagcaccgacaccguggacacccugcccgagaagaacgugaccgugacccacagcgugaaccugcuggaggacacccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaucugcuaccccggccacuucgccgacuacgaggagcugagagagcagcugagcagcgugagcagcuucgagagauucgagaucuuccccaaggagagcagcuggcccaaccacaccgccaccggcgugagcgccagcugcagccacaacggcaagagcagcuucuacaagaaccugcuguggcugaccgugaagaacggccuguaccccaaccugagcaagagcuacgccaacaacaaggagaaggaggugcuggugcuguggggcgugcaccaccccaccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaagagcaacgcccccauggacgagugcaacgccaagugccagaccccccagggcgccaucaacagcagccugcccuuccagaacgugcaccccgugaccaucggcgagugccccaaguacgugagaagcaccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccguggacaaggaguucaacaagcuggagagaagaauggagaacuucaacaagaagguggacgacggcuucaucgacaucuggaccuacaacgccgagcugcugauccugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagcauggugcugcuggugagccugggcgccaucagcuucuggaugugcagcaacggcagccugcagugcagaaucugcaucuga

SEQ ID NO: 166340 - RNA, 1701 nt, Artificial Sequence; identical to SEQ ID NO: 165086
  derived and/or modified sequence opt4 from hemagglutinin__InfluenzaA__BAO79716

SEQ ID NO: 166341 - RNA, 1683 nt, Artificial Sequence
  derived and/or modified sequence opt4 from Hemagglutinin__InfluenzaA__CAB95856
auggagaccaucagccugaucaccauccugcugguggugaccgccagcaacgccgacaagaucugcaucggccaccagagcaccaacagcaccgagaccguggacacccugaccgagaccaacgugcccgugacccacgccaaggagcugcugcacaccgagcacaacggcaugcugugcgccaccagccugggccacccccugauccuggacaccugcaccaucgagggccugguguacggcaaccccagcugcgaccugcugcugggcggcagagaguggagcuacaucguggagagaagcagcgccgugaacggcaccugcuaccccggcaacguggagaaccuggaggagcugagaacccuguucagcagcgccagcagcuaccagagaauccagaucuuccccgacaccaccuggaacgugaccuacaccggcaccagcagagccugcagcggcagcuucuacagaagcaugagauggcugacccagaagagcggcuucuaccccgugcaggacgcccaguacaccaacaacagaggcaagagcauccuguucguguggggcauccaccacccccccaccuacaccgagcagaccaaccuguacaucagaaacgacaccaccaccagcgugaccaccgaggaccugaacagaaccuucaagcccgugaucggccccagaccccuggugaacggccugcagggcagaaucgacuacuacuggagcgugcugaagcccggccagacccugagagugagaagcaacggcaaccugaucgcccccugguacggccacgugcugagcggcggcagccacggcagaauccugaagaccgaccugaagggcggcaacugcguggugcagugccagaccgagaagggcggccugaacagcacccugcccuuccacaacaucagcaaguacgccuucggcaccugccccaaguacgugagagugaacagccugaagcuggccgugggccugagaaacgugcccgccagaagcagcagaggccuguucggcgccaucgccggcuucaucgagggcggcuggcccggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacgugugggccuacaacgccgagcugcuggugcugcuggagaaccagaagacccuggacgagcacgacgccaacgugaacaaccuguacaacaaggugaagagagcccugggcagcaacgccauggaggacggcaagggcugcuucgagcuguaccacaagugcgacgaccagugcauggagaccaucagaaacggcaccuacaacagaagaaaguacagagaggagagcagacuggagagacagaagaucgagggcgugaagcuggagagcgagggcaccuacaagauccugaccaucuacagcaccguggccagcagccuggugcuggccaugggcuucgccgccuuccuguucugggccaugagcaacggcagcugcagaugcaacaucugcaucuga

SEQ ID NO: 166342 - RNA, 1683 nt, Artificial Sequence
  derived and/or modified sequence opt4 from Hemagglutinin__InfluenzaA__CAB95857
auggagaccaucagccugaucaccauccugcugguggugaccgccagcaacgccgacaagaucugcaucggccaccagagcaccaacagcaccgagaccguggacacccugaccgagaccaacgugcccgugacccacgccaaggagcugcugcacaccgagcacaacggcaugcugugcgccaccagccugggccacccccugauccuggacaccugcaccaucgagggccugguguacggcaaccccagcugcgaccugcugcuggagggcagagaguggagcuacaucguggagagaagcagcgccgugaacggcaccugcuaccccggcaacguggagaaccuggaggagcugagaacccuguucagcagcgccagcagcuaccagagaauccagaucuuccccgacaccaccuggaacgugaccuacaccggcaccagcagagccugcagcggcagcuucuacagaagcaugagauggcugacccagaagagcggcuucuaccccgugcaggacgcccaguacaccaacaacagaggcaagagcauccuguucguguggggcauccaccacccccccaccuacaccgagcagaccaaccuguacaucagaaacgacaccaccaccagcgugaccaccgaggaccugaacagaaccuucaagcccgugaucggccccagaccccuggugaacggccugcagggcagaaucgacuacuacuggagcgugcugaagcccggccagacccugagagugagaagcaacggcaaccugaucgcccccugguacggccacgugcugagcggcggcagccacggcagaauccugaagaccgaccugaagagcggcaacugcguggugcagugccagaccgagaagggcggccugaacagcacccugcccuuccacaacaucagcaaguacgccuucggcaccugccccaaguacgugagagugaacagccugaagcuggccgugggccugagaaacgugcccgccagaagcagcagaggccuguucggcgccaucgccggcuucaucgagggcggcuggcccggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacgugugggccuacaacgccgagcugcuggugcugcuggagaaccagaagacccuggacgagcacgacgccaacgugaacaaccuguacaacaaggugaagagagcccugggcagcaacgccauggaggacggcaagggcugcuucgagcuguaccacaagugcgacgaccagugcauggagaccaucagaaacggcaccuacaacagaagaaaguacagagaggagagcagacuggagagacagaagaucgagggcgugaagcuggagagcgagggcgccuacaagauccugaccaucuacagcaccguggccagcagccuggugcuggccaugggcuucgccgccuuccuguucugggccaugagcaacggcagcugcagaugcaacaucugcaucuga

SEQ ID NO: 166343 - RNA, 1707 nt, Artificial Sequence
  derived and/or modified sequence opt4 from hemagglutinin__InfluenzaA__CBW54815
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccccaacgugagcgaguggagcuacaucguggagaagaccaaccccgccaacgaccugugcuaccccggcaacuucgacaacuacgaggagcugaagcaccugcugagcagaaucaacagauucgagaagauccagaucauccccaagagcagcuggcccgaccacgaggccagccugggcgugagcagcgccugccccuaccagggcggccccagcuucuacagaaacgugguguggcugaucaagaagaacaacaccuaccccaccaucaaggagagcuaccacaacaccaaccaggaggaccugcuggugcuguggggcauccaccaccccaacgacgaggaggagcagaccagaaucuacaagaaccccaccaccuacaucagcgugggcaccagcacccugaaccagagacuggugcccaagaucgccaccagaagcaaggugaacggccagagcggcagaguggaguucuucuggaccauccugaagagcaacgacaccaucaacuucgagagcaacggcaacuucaucgcccccgagaacgccuacaagaucgugaagaagggcgacagcaccaucaugaagagcgagcuggaguacggcaacugcagcaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagggcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagaagagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 166344 - RNA, 1707 nt, Artificial Sequence
  derived and/or modified sequence opt4 from hemagglutinin__InfluenzaA__CBW54817
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccccaacgugagcgaguggagcuacaucguggagaagaucaaccccgccaacgaccugugcuaccccggcaacuucaacaacuacgaggagcugaagcaccugcugagcagaaucaacagauucgagaagauccagaucauccccaagagcagcuggcccgaccacgaggccagccugggcgugagcagcgccugccccuaccagagaggccccagcuucuacagaaacgugguguggcugaucaagaagaacgacaccuaccccaccaucaaggagagcuaccacaacaccaaccaggaggaccugcuggugcuguggggcauccaccaccccaacgacgaggaggagcagaagagaaucuacaagaaccccaccaccuacaucagcgugggcaccagcacccugaaccagagacuggugcccaagaucgccaccagaagcaaggugaacggccagagcggcagaguggaguucuucuggaccauccugaagagcaacgacaccaucaacuucgagagcaacggcaacuucaucgcccccgagaacgccuacaagaucgugaagaagggcgacagcaccaucaugaagagcgagcuggaguacggcaacugcagcaccaagugccagacccccaucggcgccaucaacaccagcaugcccuuccacaacauccacccccugaccaucggcgagugccccaaguacgugaagagcaacagacuggugcuggccaccggccugagaaacagcccccagggcgagggcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagaagagaaucgagaaccugaacaagaagauggaggacggcuuccuggacguguggaccuacaacgccgagcugcuggugcugauggagaacgagagaacccuggacuuccacgacagcaacgugagaaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 166345 - RNA, 1707 nt, Artificial Sequence
  derived and/or modified sequence opt4 from hemagglutinin__InfluenzaA__CBW54818
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccccaacgugagcgaguggagcuacaucguggagaagaccaaccccgccaacgaccugugcuaccccggcaacuucaacaacuacgaggagcugaagcaccugcugagcagaaucaacagauucgagaagaucaagaucauccccaagagcagcuggcccgaccacgaggccagccugggcgugagcagcgccugccccuaccagggcggccccagcuucuacagaaacgugguguggcugaucaagaagaacaacaccuaccccaccaucaaggagagcuaccacaacaccaaccaggaggaccugcuggugcuguggggcauccaccaccccaacgacgaggaggagcagaccagaaucuacaagaaccccaccaccuacaucagcgugggcaccagcacccugaaccagagacuggugcccaagaucgccaccagaagcaaggugaacggccagagcggcagaguggaguucuucuggaccauccugaagagcaacgacaccaucaacuucgagagcaacggcaacuucaucgcccccgagaacgccuacaagaucgugaagaagggcgacagcaccaucaugaagagcgagcuggaguacggcaacugcagcaccaagugccagacccccgugggcgccaucaacagcagcaugcccuuccacaacauccacccccugaccaucggcgagugccccaaguacgugaagagcaacagacuggugcuggccaccggccugagaaacagcccccagggcgagggcagaagaaagaagagaggccuguucggcgccaucgccggcuucaucgagggcggcuggcagggcaugguggacggcugguacggcuaccaccacagcaacgagcagggcagcggcuacgccgccgacagagagagcacccagaaggccaucgacggcgugaccaacaaggugaacagcaucaucgacaagaugaacacccaguucgaggccgugggcagagaguucaacaaccuggagaagagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaucguggccggccugcugcuguggaugugcagcaacggcagccugcagugcagaaucugcaucuga

SEQ ID NO: 166346 - RNA, 1701 nt, Artificial Sequence
  derived and/or modified sequence opt4 from hemagglutinin__InfluenzaA__CCG47908
augaagaccgugaucgcccugagcuacguguucugccugggcuucggccagggccugcccggcaagggcaacaacaccgccacccugugccugggccaccacgccgugcccaacggcacccuggugaagaccaucaccgacgaccagaucgaggugaccaacgccaccgagcuggugcagaacuucagcaugggcaagaucugcaagaacccccacagaauccuggacggcgccaacugcacccugaucgacagccugcugggcgacccccacugcgacggcuuccaggacgagaagugggaccuguucaucgagagaagcaaggccuucagcaacugcuaccccuacgacgugcccgaguacaccagccugagaagcaucaucgccagcagcggcacccuggaguucaccaacgaggacuucaacuggaccggcgugacccagaacggcggcagcagcgccugcaagagaggccccaacaacagcuucuucagcagacugaacuggcuguacaagagcggcaacaccuaccccaugcugaacgugaccaugcccaacagcgacgacuucgacaagcuguacaucuggggcgugcaccaccccagcaccgacagagagcagaccaaccuguacauccaggccagcggcaagaucaucgugagcaccaagagaagccagcagaccaucauccccaacaucggcagcagacccugggugagaggccugagcagcagaaucagcaucuacuggaccaucgugaagcccggcgacauccugaucaucaacagcaacggcaaccugaucgcccccagaggcuacuucaagauccagaccggcaagagcagcgugaugagaagcgacgcccccaucgacaccugcaacagcgagugcaucacccccaacggcagcauccccaacgacaagcccuuccagaacgugaacagaaucaccuacggcgccugccccaaguacaucaagcagaacacccugaagcuggccaccggcaugagaaacauccccgagagacagaccagaggcaucuucggcgccaucgccggcuucaucgagaacggcugggagggcauggugaacggcugguacggcuucagacaccagaacagcgagggcaucggccaggccgccgaccugaagagcacccaggccgccaucaaccagaucaacggcaagcugaacagagugaucgagaagaccaacgagaaguuccaccagaucgagaaggaguucagcgagguggagggcagaauccaggaccuggagagauacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacagcugcauggagagcaucagaaacggcaccuacgaccacaacgaguacagagacgaggccgugaacaacagauuccagaucaagagcguggagcugaagagcggcuacaaggacuggauccuguggaucagcuucgccaucagcugcuuccugcugugcgccguguggcugggcuucaucaucugggccugccagaagggcaacaucagaugcaacaucugcaucuga

SEQ ID NO: 166347 - RNA, 1701 nt, Artificial Sequence
  derived and/or modified sequence opt4 from hemagglutinin_precursor_(high_yield_phenotype)__InfluenzaA_ _AAB39851
augaaggccauccugcuggugcugcugugcaccuucgccgccaccaacgccgacacccugugcaucggcuaccacgccaacaacagcaccgacaccguggacaccgugcuggagaagaacgugaccgugacccacagcgugaaccugcuggaggacagacacaacggcaagcugugcaagcugggcggcaucgccccccugcaccugggcaagugcaacaucgccggcagacugcugggcaaccccgagugcgagcugcugcugaccgugagcagcuggagcuacaucguggagaccagcaagagcgacaacggcaccugcuaccccggcgacuucaucaacuacgaggagcugagagagcagcugagcagcgugagcagcuucgagagauucgagaucuuccccaagaccagcagcuggcccaaccacgagaccaacagaggcgugaccgccgccugccccuacgccggcgccaacagcuucuacagaaaccugaucuggcuggugaagaaggagaacagcuaccccaagcugagcaagagcuacgugaacaacaagggcaaggaggugcuggugcuguggggcauccaccacccccccaccagcaccgaccagcagagccuguaccagaacgccgacgccuacguguucgugggcagcagcaaguacaacagaaaguucaagcccgagaucgccgccagacccaaggugagaggccaggccggcagaaugagcuacuacuggacccugaucgagcccggcgacaccaucaccuucgaggccaccggcaaccugguggugcccagauacgccuucgccaugaacagaggcagcggcagcggcaucaucaucugggacgcccccgugcacgacugcaacaccaagugccagacccccaagggcgccaucaacaccagccugcccuuccagaacauccaccccgugaccaucggcgagugccccaaguacgugaagagcaccaagcugagaauggccaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccagagaagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuuccacgacagcaacgugaagaaccuguacgagaaggugagaagccagcugagaaacaacgccaaggagaucggcaacggcugcuucgaguucuaccacaagugcgacgacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 166348 - RNA, 1701 nt, Artificial Sequence
  derived and/or modified sequence opt4 from hemagglutinin_precursor__InfluenzaA__AAA43178
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcauccaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggagaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 166349 - RNA, 1689 nt, Artificial Sequence
  derived and/or modified sequence opt4 from hemagglutinin_precursor__InfluenzaA__AAA43185
auggccaucaucuaccugauccugcuguucaccgccgugagaggcgaccagaucugcaucggcuaccacgccaacaacagcaccgagaagguggacaccaaccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaaggagggcagcgacuaccccguggccaagggcagcuacaacaacaccagcggcgagcagaugcugaucaucuggggcgugcaccaccccaucgacgagaccgagcagagaacccuguaccagaacgugggcaccuacgugagcgugggcaccagcacccugaacaagagaagcacccccgagaucgccaccagacccaaggugaacggccagggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucggcaaccuggagagaagacuggagaaccugaacaagagaauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 166350 - RNA, 1701 nt, Artificial Sequence
  derived and/or modified sequence opt4 from hemagglutinin_precursor__InfluenzaA__AAA43187
augaagaccaucaucgcccugagccacaucuucugccuggugcugggccaguaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcgagagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacgccaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccagaaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuacgacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 166351 - RNA, 1698 nt, Artificial Sequence
  derived and/or modified sequence opt4 from hemagglutinin_precursor__InfluenzaA__AAA43209
augaaggccaagcugcuggugcugcuguacgccuucguggccaccgacgccgacaccaucugcaucggcuaccacgccaacaacagcaccgacaccguggacaccaucuucgagaagaacguggccgugacccacagcgugaaccugcuggaggacagacacaacggcaagcugugcaagcugaagggcaucgccccccugcagcugggcaagugcaacaucaccggcuggcugcugggcaaccccgagugcgacagccugcugcccgccagaagcuggagcuacaucguggagacccccaacagcgagaacggcgccugcuaccccggcgacuucaucgacuacgaggagcugagagagcagcugagcagcgugagcagccuggagagauucgagaucuuccccaaggagagcagcuggcccaaccacaccuucaacggcgugaccgugagcugcagccacagaggcaagagcagcuucuacagaaaccugcuguggcugaccaagaagggcgacagcuaccccaagcugaccaacagcuacgugaacaacaagggcaaggaggugcuggugcuguggggcgugcaccaccccagcagcagcgacgagcagcagagccuguacagcaacggcaacgccuacgugagcguggccagcagcaacuacaacagaagauucacccccgagaucgccgccagacccaaggugaaggaccagcacggcagaaugaacuacuacuggacccugcuggagcccggcgacaccaucaucuucgaggccaccggcaaccugaucgcccccugguacgccuucgcccugagcagaggcuucgagagcggcaucaucaccagcaacgccagcaugcacgagugcaacaccaagugccagaccccccagggcagcaucaacagcaaccugcccuuccagaacauccaccccgugaccaucggcgagugccccaaguacgugagaagcaccaagcugagaauggugaccggccugagaaacauccccagcauccaguacagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagaagagaauggagaaccugaacaagaagguggacgacggcuuccuggacaucuggaccuacaacgccgagcugcuggugcugcuggagaacgagagaacccuggacuuccacgaccugaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 166352 - RNA, 1683 nt, Artificial Sequence
  derived and/or modified sequence opt4 from hemagglutinin_precursor__InfluenzaA__AAC40998
augaacacccagauccugauccuggcccugguggccaucauccccaccaacgccgacaagaucugccugggccaccacgccgugagcaacggcgccaaggugaacacccugaccgagagaggcguggagguggugaacgccaccgagaccguggagagaaccaacgugcccagaaucugcagcaagggcaagagaaccguggaccugggccagugcggccugcugggcaccaucaccggccccccccagugcgaccaguuccuggaguucagcgccgaccugaucaucgagagaagagagggcaacgacgugugcuaccccggcaaguucgugaacgaggaggcccugagacagauccugagaaagagcggcggcaucgacaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaucagaaaggaccccgcccugaucaucuggggcauccaccacagcggcagcaccgccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcgaggugcagguggacgccaacugcgagggcgacugcuaccacagcggcggcaccauccugagcagccugcccuuccagaacaucaacagcagaaccgugggcgagugccccagauacgugaagcaggagagccugcugcuggccaccggcaugaagaacgugcccgagauccccaagggcagaggccuguucggcgccaucgccggcuucaucgagaacggcugggagggccugguggacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagaagcagaucggcaacgugaucaacuggaccagagacagccugaccgagauguggagcuacaacgccgagcugcugguggccauggagaaccagcacaccaucgaccuggccgacagcgagaugaacaagcuguacgagagagugagaagacagcugagagagaacgccgaggaggacggcaccggcugcuucgagaucuuccacaagugcgacgacgacugcauggccagcaucagaaacaacaccuacgaccacagcaaguacagagaggaggccauccagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 166353 - RNA, 1683 nt, Artificial Sequence
  derived and/or modified sequence opt4 from hemagglutinin_precursor__InfluenzaA__AAC40999
augaacacccagauccugauccuggcccugguggccaucauccccaccaacgccgacaagaucugccugggccaccacgccgugagcaacggcaccaaggugaacacccugaccgagagaggcguggagguggugaacgccaccgagaccguggagagaaccaacgugcccagaaucugcagcaagggcaagagaaccguggaccugggccagugcggccugcugggcaccaucaccggccccccccagugcgaccaguuccuggaguucagcgccgaccugaucaucgagagaagagagggcgacgacgugugcuaccccggcaaguucgugaacgaggaggcccugagacagauccugagagagagcggcggcaucgacaaggagaccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaucagaaaggaccccgcccugaucaucuggggcauccaccacagcggcagcaccgccgagcagaccaagcuguacggcagcggcaacaagcugaucaccgugggcagcagcaacuaccagcagagcuucgugcccauccccggcgccagaccccaggugaacggccagagcggcagaaucgacuuccacuggcugaugcugaaccccaacgacaccgugaccuucagcuucaacggcgccuucaucgcccccgacagagccagcuuccugagaggcaagagcaugggcauccagagcgaggugcagguggacgccaacugcgagggcgacugcuaccacagcggcggcaccauccugaacaaccugcccuuccagaacaucaacggcagagccgugggcaagugccccagauacgugaagcaggagagccugcugcuggccaccggcaugaagaacgugcccgagauccccaagggcagaggccuguucggcgccaucgccggcuucaucgagaacggcugggagggccugguggacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagaagcagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaagacagcugagagagaacgccgaggaggacggcaccggcugcuucgagaucuuccacaagugcgacgacgacugcauggccagcaucagaaacaacaccuacgaccacagcaaguacagagaggaggccauccagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 166354 - RNA, 1698 nt, Artificial Sequence; identical to SEQ ID NO: 155008
  derived and/or modified sequence opt4 from hemagglutinin__InfluenzaA__ACA28844

SEQ ID NO: 166355 - RNA, 1698 nt, Artificial Sequence; identical to SEQ ID NO: 160313
  derived and/or modified sequence opt4 from hemagglutinin__InfluenzaA__ACA28844/m1

SEQ ID NO: 166356 - RNA, 1701 nt, Artificial Sequence; identical to SEQ ID NO: 161670
  derived and/or modified sequence opt4 from hemagglutinin__InfluenzaA__ACV82259

SEQ ID NO: 166357 - RNA, 1701 nt, Artificial Sequence; identical to SEQ ID NO: 161670
  derived and/or modified sequence opt4 from hemagglutinin__InfluenzaA__ACV82259/m1

SEQ ID NO: 166358 - RNA, 1701 nt, Artificial Sequence; identical to SEQ ID NO: 161670
  derived and/or modified sequence opt4 from hemagglutinin__InfluenzaA__ACV82259/m2

SEQ ID NO: 166359 - RNA, 1701 nt, Artificial Sequence; identical to SEQ ID NO: 155187
  derived and/or modified sequence opt4 from hemagglutinin__InfluenzaA__ACP41953

SEQ ID NO: 166360 - RNA, 1701 nt, Artificial Sequence; identical to SEQ ID NO: 164761
  derived and/or modified sequence opt4 from hemagglutinin__InfluenzaA__AFM72832

SEQ ID NO: 166361 - RNA, 1701 nt, Artificial Sequence
  derived and/or modified sequence opt4 from hemagglutinin__InfluenzaA__EPI516528
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcacugcagaaucugcguguga

SEQ ID NO: 166362 - RNA, 1701 nt, Artificial Sequence
  derived and/or modified sequence opt4 from hemagglutinin__InfluenzaA__AGM53850
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166363 - RNA, 1701 nt, Artificial Sequence
  derived and/or modified sequence opt4 from hemagglutinin__InfluenzaA__EPI731463
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaacaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166364 - RNA, 1701 nt, Artificial Sequence; identical to SEQ ID NO: 157018
  derived and/or modified sequence opt4 from hemagglutinin__InfluenzaA__EPI696972

SEQ ID NO: 166365 - RNA, 1701 nt, Artificial Sequence; identical to SEQ ID NO: 166206
  derived and/or modified sequence opt4 from hemagglutinin__InfluenzaA__EPI662594

SEQ ID NO: 166366 - RNA, 1701 nt, Artificial Sequence
  derived and/or modified sequence opt4 from hemagglutinin__InfluenzaA__EPI685579
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaaccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaccagacccaaggugagagacagagagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166367 - RNA, 1701 nt, Artificial Sequence
  derived and/or modified sequence opt4 from hemagglutinin__InfluenzaA__EPI830230
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaaccagagcuacaucaacgacaagggcaaggaggugcuggugcuguggggcauccaccaccccagcaccaccgccgaccagcagagccuguaccagaacgccgacgccuacguguucgugggcaccagcagauacagcaagauguucaagcccgagaucgccaccagacccaaggugagagacagagagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166368 - RNA, 1701 nt, Artificial Sequence; identical to SEQ ID NO: 155176
  derived and/or modified sequence opt4 from hemagglutinin__InfluenzaA__ACQ45338

SEQ ID NO: 166369 - RNA, 1701 nt, Artificial Sequence; identical to SEQ ID NO: 155176
  derived and/or modified sequence opt4 from hemagglutinin__InfluenzaA__ACQ45338/m1

SEQ ID NO: 166370 - RNA, 1701 nt, Artificial Sequence; identical to SEQ ID NO: 155176
  derived and/or modified sequence opt4 from hemagglutinin__InfluenzaA__ACQ45338/m2

SEQ ID NO: 166371 - RNA, 1701 nt, Artificial Sequence; identical to SEQ ID NO: 154838
  derived and/or modified sequence opt4 from hemagglutinin__InfluenzaA__ACU79871

SEQ ID NO: 166372 - RNA, 1701 nt, Artificial Sequence
  derived and/or modified sequence opt4 from hemagglutinin__InfluenzaA__ACU79871/m1
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucgagagcagacccugggugagaggccagagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaaggugaacagaaucaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaagcggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 166373 - RNA, 1701 nt, Artificial Sequence
  derived and/or modified sequence opt4 from hemagglutinin__InfluenzaA__EPI643118
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccccuacgcccagagcagcggcagaaucaucgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagcugagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166374 - RNA, 1701 nt, Artificial Sequence; identical to SEQ ID NO: 164961
  derived and/or modified sequence opt4 from hemagglutinin__InfluenzaA__EPI675798

SEQ ID NO: 166375 - RNA, 1701 nt, Artificial Sequence
  derived and/or modified sequence opt4 from hemagglutinin__InfluenzaA__EPI578430
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcagcugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccccuacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166376 - RNA, 1701 nt, Artificial Sequence
  derived and/or modified sequence opt4 from hemagglutinin__InfluenzaA__EPI614406
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcagcugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccccuacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166377 - RNA, 1695 nt, Artificial Sequence
  derived and/or modified sequence opt4 from hemagglutinin__InfluenzaA__ACU65077/m1
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 166378 - RNA, 1695 nt, Artificial Sequence; identical to SEQ ID NO: 166377
  derived and/or modified sequence opt4 from hemagglutinin__InfluenzaA__ACU65077/m2

SEQ ID NO: 166379 - RNA, 1707 nt, Artificial Sequence; identical to SEQ ID NO: 152548
  derived and/or modified sequence opt4 from hemagglutinin__InfluenzaA__ABP51976

SEQ ID NO: 166380 - RNA, 1707 nt, Artificial Sequence; identical to SEQ ID NO: 152548
  derived and/or modified sequence opt4 from hemagglutinin__InfluenzaA__ABP51976/m1

SEQ ID NO: 166381 - RNA, 1695 nt, Artificial Sequence
  derived and/or modified sequence opt4 from hemagglutinin__InfluenzaA__ABW90125
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagaagcacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcuacuggagcagccacgaggccagccugggcgugagcagcgccugccccuaccagggcaagagcagcuucuucagaaacgugguguggcugaccaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 166382 - RNA, 1695 nt, Artificial Sequence
  derived and/or modified sequence opt4 from hemagglutinin__InfluenzaA__ABW90126
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagaagcacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagggcagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 166383 - RNA, 1695 nt, Artificial Sequence
  derived and/or modified sequence opt4 from hemagglutinin__InfluenzaA__ABW90127
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagaagcacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcgagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 166384 - RNA, 1695 nt, Artificial Sequence
  derived and/or modified sequence opt4 from hemagglutinin__InfluenzaA__ABW90128
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagaagcacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucgagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 166385 - RNA, 1695 nt, Artificial Sequence
  derived and/or modified sequence opt4 from hemagglutinin__InfluenzaA__ABW90129
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagaagcacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcgccuaccccaccaucaagagaagcuacaacaacaccaaccaggaggaccugcuggugcuguggggcauccaccaccccaacgacgccgccgagcagaccgagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 166386 - RNA, 1695 nt, Artificial Sequence
  derived and/or modified sequence opt4 from hemagglutinin__InfluenzaA__ABW90130
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagaagcacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaaguucagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 166387 - RNA, 1695 nt, Artificial Sequence
  derived and/or modified sequence opt4 from hemagglutinin__InfluenzaA__ABW90132
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagaagcacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacaacgccgccgagcagaccgagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 166388 - RNA, 1695 nt, Artificial Sequence
  derived and/or modified sequence opt4 from hemagglutinin__InfluenzaA__ABW90133
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagaagcacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagcccagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 166389 - RNA, 1695 nt, Artificial Sequence
  derived and/or modified sequence opt4 from hemagglutinin__InfluenzaA__ABW90134
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagaagcacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccaggagaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 166390 - RNA, 1695 nt, Artificial Sequence
  derived and/or modified sequence opt4 from hemagglutinin__InfluenzaA__ABW90135
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagaagcacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaacaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 166391 - RNA, 1695 nt, Artificial Sequence
  derived and/or modified sequence opt4 from hemagglutinin__InfluenzaA__HB649491
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagaagcacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 166392 - RNA, 1683 nt, Artificial Sequence; identical to SEQ ID NO: 162508
  derived and/or modified sequence opt4 from hemagglutinin__InfluenzaA__EPI439507

SEQ ID NO: 166393 - RNA, 1701 nt, Artificial Sequence
  derived and/or modified sequence opt4 from hemagglutinin__InfluenzaA__EPI482777
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggagaacagacacaacggcaagcugugcaagcugagaggcguggccccccugcaccugggcaagugcaacaucgccggcuggcugcugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacaccaacagaggcgugaccgccgccugcccccacgccggcgccaacagcuucuacagaaaccugguguggcuggugaagaagggcaacagcuaccccaagaucaacaagagcuacaucaacaacaaggagaaggaggugcuggugcugugggccauccaccaccccagcaccagcgccgaccagcagagccuguaccagaacgccgacgccuacguguucgugggcagcagcagauacagcagaaaguucgagcccgagaucgccaccagacccaaggugagagaccaggccggcagaaugaacuacuacuggacccugguggagcccggcgacaagaucaccuucgaggccaccggcaaccugguggcccccagauacgccuucgcccugaagagaaacagcggcagcggcaucaucaucagcgacaccagcgugcacgacugcgacaccaccugccagacccccaacggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucagccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaugugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166394 - RNA, 1701 nt, Artificial Sequence; identical to SEQ ID NO: 158104
  derived and/or modified sequence opt4 from hemagglutinin__InfluenzaA__EPI745532

SEQ ID NO: 166395 - RNA, 1701 nt, Artificial Sequence
  derived and/or modified sequence opt4 from hemagglutinin__InfluenzaA__EPI278594
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgagagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166396 - RNA, 1701 nt, Artificial Sequence
  derived and/or modified sequence opt4 from hemagglutinin__InfluenzaA__AEE69009
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacaccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166397 - RNA, 1701 nt, Artificial Sequence; identical to SEQ ID NO: 155471
  derived and/or modified sequence opt4 from hemagglutinin__InfluenzaA__GQ280797

SEQ ID NO: 166398 - RNA, 1701 nt, Artificial Sequence; identical to SEQ ID NO: 155204
  derived and/or modified sequence opt4 from hemagglutinin__InfluenzaA__EPI178457

SEQ ID NO: 166399 - RNA, 1701 nt, Artificial Sequence; identical to SEQ ID NO: 155204
  derived and/or modified sequence opt4 from hemagglutinin__InfluenzaA__EPI176470

SEQ ID NO: 166400 - RNA, 1701 nt, Artificial Sequence
  derived and/or modified sequence opt4 from hemagglutinin__InfluenzaA__EPI280341
augaaggccauccugguggugcugcugcacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccacccugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaaaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166401 - RNA, 1701 nt, Artificial Sequence
  derived and/or modified sequence opt4 from hemagglutinin__InfluenzaA__EPI240319
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166402 - RNA, 1701 nt, Artificial Sequence; identical to SEQ ID NO: 155369
  derived and/or modified sequence opt4 from hemagglutinin__InfluenzaA__EPI183134

SEQ ID NO: 166403 - RNA, 1701 nt, Artificial Sequence
  derived and/or modified sequence opt4 from hemagglutinin__InfluenzaA__EPI368693
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccagcugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166404 - RNA, 1701 nt, Artificial Sequence
  derived and/or modified sequence opt4 from hemagglutinin__InfluenzaA__EPI291788
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggagaacagacacaacggcaagcugugcaagcugagaggcguggccccccugcaccugggcaagugcaacaucgccggcuggcugcugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacaccaacagaggcgugaccgccgccugcccccacgccggcaccaacagcuucuacagaaaccugaucuggcuggugaagaagggcaacagcuaccccaagaucaacaagagcuacaucaacaacaaggagaaggaggugcuggugcugugggccauccaccaccccagcaccagcgccgaccagcagagccuguaccagaacgccgacgccuacguguucgugggcagcagcagauacagcagaaaguucgagcccgagaucgccaccagacccaaggugagagaccaggccggcagaaugaacuacuacuggacccugguggagcccggcgacaagaucaccuucgaggccaccggcaaccugguggugcccagauacgccuucgcccugaagagaaacagcggcagcggcaucaucaucagcgacaccagcgugcacgacugcgacaccaccugccagacccccaacggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucagccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166405 - RNA, 1701 nt, Artificial Sequence
  derived and/or modified sequence opt4 from hemagglutinin__InfluenzaA__EPI482788
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggagaacagacacaacggcaagcugugcaagcugagaggcguggccccccugcaccugggcaagugcaacaucgccggcuggcugcugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacaccaacagaggcgugaccgccgccugcccccacgccggcaccaacagcuucuacagaaaccugaucuggcuggugaagaagggcaacagcuaccccaagaucaacaagagcuacaucaacaacaaggagaaggaggugcuggugcugugggccauccaccaccccagcaccagcgccgaccagcagagcaucuaccagaacgccgacgccuacguguucgugggcagcagcagauacagcagaaaguucgagcccgagaucgccaccagacccaaggugagagaccaggccggcagaaugaacuacuacuggacccugguggagcccggcgacaagaucaccuucgaggccaccggcaaccugguggugcccagauacgccuucgcccugaagagaaacagcggcagcggcaucaucaucagcgacaccagcgugcacgacugcgacaccaccugccagacccccaacggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucagccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166406 - RNA, 1701 nt, Artificial Sequence
  derived and/or modified sequence opt4 from hemagglutinin__InfluenzaA__EPI178946/m1
augaaggccaucaucguggugcugcuguacaccuucgccaccgccgacgccgacacccugugcaucggcuaccacgccaacaacagcaccgacaccguggacaccgugcuggagaagaacgugaccgugacccacagcgugaaccugcuggagaacaagcacgacggcaagcugugcaagcugagaggcguggccccccugcaccugggcaagugcaacaucgccggcuggcugcugggcaaccccgagugcgagagccuguucaccgccagcagcuggagcuacaucguggagacccccaacagcgacaacggcaccugcuaccccggcgacuucaucaacuacgaggagcugagagagcaccugagcagcgugagcagcuucgagagauucgagaucuuccccaaggccaacagcuggcccaaccacgacaccaacaagggcgugaccgccgccugccccuacgccggcgccaacagcuucuacagaaaccugaucuggcuggugaagaagggcaacagcuaccccaagcugagcaagagcuacaucaacaacaagaagaaggaggugcuggugaucuggggcauccaccacccccccaccagcaccgaccagcagacccuguaccagaacgccgacgccuacguguucgugggcagcagcaaguacagcaagagauucaagcccgagaucgccgccagacccaaggugagaaaccaggccggcagaaugaacuacuacuggacccugaucgagcccggcgacaccaucaccuucgaggccaccggcaaccugguggugcccagauacgccuucgccaugaagagaggcagcggcagcggcaucaucgugagcgacgcccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuuccuggagggcggcuggaccggcaugaucgacggcugguacggcuaccaccaccagaacgagcagggcagcggcuacgccgccgaccagaagagcacccagaacgccaucgacggcaucaccaacaaggugaacagcaucaucgagaagaugaacacccaguucaccgccgugggcaaggaguucaaccagcuggagaagagaaucgagagccugaacaacaagguggacgacggcuuccuggacaucuggaccuacaacgccgagaugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcgccagaaucuaccagauccuggccaucuacagcaccguggccagcagccuggugcugcuggugagccugggcgccgugagcuucuggaugugcagcaacggcagccugcagugcagaaucugcaucuga

SEQ ID NO: 166407 - RNA, 1701 nt, Artificial Sequence
  derived and/or modified sequence opt4 from hemagglutinin__InfluenzaA__EPI482791/m2
augaaggccaucaucguggugcugcuguacaccuucgccaccgccgacgccgacacccugugcaucggcuaccacgccaacaacagcaccgacaccguggacaccgugcuggagaagaacgugaccgugacccacagcgugaaccugcuggagaacaagcacgacggcaagcugugcaagcugagaggcguggccccccugcaccugggcaagugcaacaucgccggcuggcugcugggcaaccccgagugcgagagccuguucaccgccagcagcuggagcuacaucguggagacccccaacagcgacaacggcaccugcuaccccggcgacuucaucaacuacgaggagcugagagagcaccugagcagcgugagcagcuucgagagauucgagaucuuccccaaggccaacagcuggcccaaccacgagaccaacaagggcgugaccgccgccugccccuacgccggcgccaacagcuucuacagaaaccugaucuggcuggugaagaagggcaacagcuaccccaagcugagcaagagcuacaucaacaacaagaagaaggaggugcuggugaucuggggcauccaccacccccccaccagcaccgaccagcagacccuguaccagaacgccgacgccuacguguucgugggcagcagcaaguacagcaagagauucaagcccgagaucgccgccagacccaaggugagaaaccaggccggcagaaugaacuacuacuggacccugaucgagcccggcgacaccaucaccuucgaggccaccggcaaccugguggugcccagauacgccuucgccaugaagagaggcagcggcagcggcaucaucgugagcgacgcccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuuccuggagggcggcuggaccggcaugaucgacggcugguacggcuaccaccaccagaacgagcagggcagcggcuacgccgccgaccagaagagcacccagaacgccaucgacggcaucaccaacaaggugaacagcaucaucgagaagaugaacacccaguucaccgccgugggcaaggaguucaaccagcuggagaagagaaucgagagccugaacaacaagguggacgacggcuuccuggacaucuggaccuacaacgccgagaugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcgccagaaucuaccagauccuggccaucuacagcaccguggccagcagccuggugcugcuggugagccugggcgccgugagcuucuggaugugcagcaacggcagccugcagugcagaaucugcaucuga

SEQ ID NO: 166408 - RNA, 1701 nt, Artificial Sequence
  derived and/or modified sequence opt4 from hemagglutinin__InfluenzaA__EPI291799
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggagaacagacacaacggcaagcugugcaagcugagaggcguggccccccugcaccugggcaagugcaacaucgccggcuggcugcugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacaccaacagaggcgugaccgccgccugcccccacgccggcaccaacagcuucuacagaaaccugaucuggcuggugaagaagggcaacagcuaccccaagaucaacaagagcuacaucaacaacaaggagaaggaggugcuggugcugugggccauccaccaccccagcaccagcgccgaccagcagagccuguaccagaacgccgacgccuacguguucgugggcagcagcagauacagcagaaaguucgagcccgagaucgccaccagacccaaggugagagaccaggccggcagaaugaacuacuacuggacccugguggagcccggcgacaagaucaccuucgaggccaccggcaaccugguggugcccagauacgccuucgcccugaagagaaccagcggcagcggcaucaucaucagcgacaccagcgugcacgacugcgacaccaccugccagacccccaacggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucagccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166409 - RNA, 1701 nt, Artificial Sequence
  derived and/or modified sequence opt4 from hemagglutinin__InfluenzaA__EPI482799
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggagaacagacacaacggcaagcugugcaagcugagaggcguggccccccugcaccugggcaagugcaacaucgccggcuggcugcugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgagaccaacagaggcgugaccgccgccugcccccacgccggcaccaacagcuucuacagaaaccugaucuggcuggugaagaagggcaacagcuaccccaagaucaacaagagcuacaucaacaacaaggagaaggaggugcuggugcugugggccauccaccaccccagcaccagcgccgaccagcagagccuguaccagaacgccgacgccuacguguucgugggcagcagcagauacagcagaaaguucgagcccgagaucgccaccagacccaaggugagagaccaggccggcagaaugaacuacuacuggacccugguggagcccggcgacaagaucaccuucgaggccaccggcaaccugguggugcccagauacgccuucgcccugaagagaaccagcggcagcggcaucaucaucagcgacaccagcgugcacgacugcgacaccaccugccagacccccaacggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucagccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166410 - RNA, 1701 nt, Artificial Sequence
  derived and/or modified sequence opt4 from hemagglutinin__InfluenzaA__EPI291807
augaaggccaucaucguggugcugcuguacaccuucgccaccgccgacgccgacacccugugcaucggcuaccacgccaacaacagcaccgacaccguggacaccgugcuggagaagaacgugaccgugacccacagcgugaaccugcuggagaacaagcacgacggcaagcugugcaagcugagaggcguggccccccugcaccugggcaagugcaacaucgccggcuggcugcugggcaaccccgagugcgagagccuguucgccgccagcagcuggagcuacaucguggagacccccaacagcgacaacggcaccugcuaccccggcgacuucaucaacuacgaggagcugagagagcaccugagcagcgugagcagcuucgagagauucgagaucuuccccaaggccaacagcuggcccaaccacgacaccaacaagggcgugaccgccgccugccccuacgccggcgccaacagcuucuacagaaaccugaucuggcuggugaagaagggcaacagcuaccccaagcugagcaagagcuacaucaacaacaagaagaaggaggugcuggugaucuggggcauccaccacccccccaccagcaccgaccagcagacccuguaccagaacgccgacgccuacguguucgugggcagcagcaaguacagcaagagauucaagcccgagaucgccgccagacccaaggugagagaccaggccggcagaauggacuacuacuggacccugaucgagcccggcgacaccaucaccuucgaggccaccggcaaccugguggugcccagauacgccuucgccaugaagagaggcagcggcagcggcaucaucgugagcgacgcccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcaucaucgagaagaugaacacccaguucaccgccgugggcaaggaguucagccagcuggagaagagaaucgagagccugaacaacaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcgccagaaucuaccagauccuggccaucuacagcaccguggccagcagccuggugcugcuggugagccugggcgccgugagcuucuggaugugcagcaacggcagccugcagugcagaaucugcaucuga

SEQ ID NO: 166411 - RNA, 1701 nt, Artificial Sequence
  derived and/or modified sequence opt4 from hemagglutinin__InfluenzaA__EPI638970
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggagaacagacacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgagaacggcaccugcuaccccggcgacuucaucaacuacgaggagcugagagagcagcugagcagcgugagcagcuucgagagauucgagaucuuccccaagaccagcagcuggcccaaccacgacaccaacaagggcgugaccgccgccugcccccacagcggcaccaacagcuucuacagaaaccugguguggcuggugcagaagggcaacagcuaccccaagaucaacaagagcuacaucaacaacaaggagaacgaggugcuggugcugugggccauccaccaccccagcaccagcgccgaccagcagagccuguacaagaacgccgacgccuacguguucgugggcagcagcagauacagcagaaaguucgagcccgagaucgccaccagacccaaggugagagaccaggccggcagaaugaacuacuacuggacccugguggagcccggcgacaagaucaccuucgaggccaccggcaaccugguggcccccagauacgccuucacccugaagagaaacagcggcagcggcaucaucaucagcgacaccagcgugcacgacugcgacaccaccugccagacccccaacggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucagccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaugugcauggagagcgugaagaacggcaccuacgacuaccccaaguacagcgaggaggccaagcugaacagagaggagaucgacggcgugaagcuggagagcaccaagaucuaccagauccuggccaucuacagcaccguggccagcagccuggugcugguggugagccugggcgccaucagcuucuggaugugcagcaacggcagccugcagugcagaaucugcaucuga

SEQ ID NO: 166412 - RNA, 1701 nt, Artificial Sequence
  derived and/or modified sequence opt4 from hemagglutinin__InfluenzaA__ABI19015
augaaggccaucaucguggugcugcuguacaccuucgccaccgccgacgccgacacccugugcaucggcuaccacgccaacaacagcaccgacaccguggacaccgugcuggagaagaacgugaccgugacccacagcgugaaccugcuggagaacaagcacgacggcaagcugugcaagcugagaggcaucgccccccugcaccugggcaagugcaacaucgccggcuggauccugggcaaccccgagugcgagagccuguucaccaccagcagcuggagcuacaucguggagacccccaacagcgacaacggcaccugcuaccccggcgacuucaucaacuacgaggagcugagagagcaccugagcagcgugagcagcuucgagagauucgagaucuuccccaaggccaacagcuggcccuaccacgacaccaacaagggcgugaccgccgccugccccuacgccggcgccaacagcuucuacagaaaccugaucuggcuggugaagaagggcaacagcuaccccaagcugagcaagagcuacaucaacaacaagaagaaggaggugcuggugaucuggggcauccaccacccccccaccagcaccgaccagcagacccuguaccagaacgccgacgccuacguguucgugggcagcagcaaguacagcaagagauucaagcccgagaucgccgccagacccaaggugagagaccaggccggcagaauggacuacuacuggacccugaucgagcccggcgacaccaucaccuucgaggccaccggcaaccugguggugcccagauacgccuucaccaugaagagaggcagcggcagcggcaucaucgugagcgacgcccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcaucaucgagaagaugaacacccaguucaccgccgugggcaaggaguucagccagcuggagaagagaaucgagagccugaacaacaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggaggccaagcugaacagacaggagaucgacggcgugaagcuggagagcgccagaaucuaccagauccuggccaucuacagcaccguggccagcagccuggugcugcuggugagccugggcgccgugagcuucuggaugugcagcaacggcagccugcagugcagaaucugcaucuga

SEQ ID NO: 166413 - RNA, 1701 nt, Artificial Sequence
  derived and/or modified sequence opt4 from hemagglutinin__InfluenzaA__EPI687790
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugggcggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaaccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaccagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166414 - RNA, 1701 nt, Artificial Sequence
  derived and/or modified sequence opt4 from hemagglutinin__InfluenzaA__EPI841265
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugggcggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaaccagagcuacaucaacgacaagggcaaggaggugcuggugcuguggggcauccaccaccccagcaccaccgccgaccagcagagcaucuaccagaacgccgacgccuacguguucgugggcaccagcagauacagcaagaaguucaagcccgagaucgccaccagacccaaggugagagaccaggagggcagaaucaacuacuacuggacccugguggagcccggcgacaagaucaccuucgaggccaccggcaaccugguggugcccagauacgccuucaccauggagagaaacgccggcagcggcaucaucaucagcaacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166415 - RNA, 1701 nt, Artificial Sequence
  derived and/or modified sequence opt4 from hemagglutinin__InfluenzaA__EPI291846
augaaggccaucaucguggugcugcuguacaccuucgccaccgccgacgccgacacccugugcaucggcuaccacgccaacaacagcaccgacaccguggacaccgugcuggagaagaacgugaccgugacccacagcgugaaccugcuggagaacaagcacgacggcaagcugugcaaccugaagggcguggccccccugcaccugggcaagugcaacaucgccggcuggcugcugggcaaccccgagugcgagagccuguucaccgccagcagcuggagcuacaucguggagacccccaacagcgacaacggcaccugcuaccccggcgacuucaucaacuacgaggagcugagagagcaccugagcagcgugagcagcuucgagagauucgagaucuuccccaaggugaacagcuggcccaaccacgacaccaacaagggcgugaccgccgccugccccuacgccggcgccaacagcuucuacagaaaccugaucuggcuggugaagaagggcaacagcuaccccaagcugagcaagagcuacaucaacaacaagaagaaggaggugcuggugaucuggggcauccaccacccccccaccagcaccgaccagcagacccuguaccagaacgccgacgccuacguguucgugggcagcagcaaguacagcaagagauucgagcccgagaucgccgccagacccaaggugagaaaccaggccggcagaaugaacuacuacuggacccugaucgagcccggcgacaccaucaccuucgaggccaccggcaaccugguggugcccagauacgccuucgccaugagaagaggcagcggcagcggcaucaucgugagcgacgcccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuuccuggagggcggcuggaccggcaugaucgacggcugguacggcuaccaccaccagaacgagcagggcagcggcuacgccgccgaccagaagagcacccagaacgccaucgacggcaucaccaacaaggugaacagcaucaucgagaagaugaacacccaguucaccgccgugggcaaggaguucagccagcuggagaagagaaucgagagccugaacaacaagguggacgacggcuuccuggacaucuggaccuacaacgccgagaugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugagaaacggcaccuacgacuaccccaaguacagcgaggaggccaagcugaacagagaggagaucgacggcgugaagcuggagagcgccagaaucuaccagauccuggccaucuacagcaccguggccagcagccuggugcugcuggugagccugggcgccgugagcuucuggaugugcagcaacggcagccugcagugcagaaucugcaucuga

SEQ ID NO: 166416 - RNA, 1695 nt, Artificial Sequence
  derived and/or modified sequence opt4 from hemagglutinin__InfluenzaA__EPI558121
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggagaacagacacaacggcaagcugugcaagcugagaggcguggccccccugcaccugggcaagugcaacaucgccggcuggcugcugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuucccccagaccagcagcuggcccaaccacgacaccaacagaggcgugaccgccgccugcccccacgccggcaccaacagcuucuacagaaaccugguguggcuggugaagaagggcaacagcuacagcaagaucaacaagagcuacaucaacaacaaggagaaggaggugcuggugcugugggccauccaccaccccagcaccagcgccgaccagcagagccuguaccagaacgccgacgccuacguguucgugggcagcagcagauacagcagaaaguucgagcccgagaucgccaccagacccaaggugagagaccaggccggcagaaugaacuacuacuggacccugguggagcccggcgacaagaucaccuucgaggccaccggcaaccugguggcccccagauacgccuucgcccugaagagaaacagcggcagcggcaucaucaucagcgacaccagcgugcacgacugcgacaccaccugccagacccccaacggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucagccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaugugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucuga

SEQ ID NO: 166417 - RNA, 1701 nt, Artificial Sequence; identical to SEQ ID NO: 164961
  derived and/or modified sequence opt4 from hemagglutinin__InfluenzaA__EPI564139

SEQ ID NO: 166418 - RNA, 1701 nt, Artificial Sequence; identical to SEQ ID NO: 166206
  derived and/or modified sequence opt4 from hemagglutinin__InfluenzaA__EPI786706

SEQ ID NO: 166419 - RNA, 1701 nt, Artificial Sequence
  derived and/or modified sequence opt4 from hemagglutinin__InfluenzaA__EPI395313
augaaggccauccugaucgugcugcuguacaccuucaccaccgccaacgccgacacccugugcaucggcuaccacgccaacaacagcaccgacaccguggacaccgugcuggagaagaacgugaccgugacccacagcgugaaccugcuggagaacagacacaacggcaagcugugcaagcugagaggcguggccccccugcaccugggcaagugcaacaucgccggcuggcugcugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacaccaacagaggcgugaccgccgccugcccccacgccggcaccaagagcuucuacaagaaccugaucuggaucgccaagaagggcaacagcuaccccaagaucaacaagagcuacaucaacaacaaggagaaggaggugcuggugcugugggccauccaccaccccagcaccagcgccgaccagcagagccuguaccagaacgccgacgccuacguguucgugggcagcagcagauacagcagaaaguucgagcccgagaucgccaccagacccaaggugagagaccaggccggcagaaugaacuacuacuggacccugguggagcccggcgacaagaucaccuucgaggccaccggcaaccugguggcccccagauacgccuucgcccugaagagaaacagcggcagcggcaucaucaucagcgacaccagcgugcacgacugcgacaccaccugccagacccccaacggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucagccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaugugcauggagagcgugaagaacggcaccuacgacuaccccaaguacagcgaggaggccaagcugaacagagaggugaucgacggcgugaagcuggagagcaccagaaucuaccagauccuggccaucuacgccaccguggccagcagccuggugcugguggugagccugggcgccaucagcuucuggaugugcagcaacggcagccugcagugcagaaucugcaucuga

SEQ ID NO: 166420 - RNA, 1701 nt, Artificial Sequence
  derived and/or modified sequence opt4 from hemagglutinin__InfluenzaA__EPI291696
augaaggccauccugcuggugcugcuguacaccuucaccgccgccaacgccgacacccugugcaucggcuaccacgccaacaacagcaccgacaccguggacaccgugcuggagaagaacgugaccgugacccacagcgugaaccugcuggagaacagacacaacggcaagcugugcaagcugagaggcgugcccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccgaccacgagaccaacagaggcgugaccgccgccugccccuacgccggcgccaacagcuucuacagaaaccugaucuggcuggugaagaagggcaacagcuaccccaagcugagcaagagcuacgugaacaacaaggagaaggaggugcuggugcuguggggcauccaccacccccccaccagcaccgaccagcagagccuguaccagaacgccgacgccuacguguucgugggcagcagcaaguacaacaagaaguucaagcccgagauggccgccagacccaaggugagaggccaggccggcagaaugaacuacuacuggacccugguggcccccggcgacaccaucaccuucgaggccaccggcaaccugguggugcccagauacgccuucgccaugaagagaggcagcggcagcggcaucaucaucagcgacacccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccguggccagcagccuggugcugagcgugagccugggcgccaucagcuucuggaugugcagcaacggcagccugcagugcagaaucugcaucuga

SEQ ID NO: 166421 - RNA, 1701 nt, Artificial Sequence; identical to SEQ ID NO: 162351
  derived and/or modified sequence opt4 from hemagglutinin__InfluenzaA__ACU80014

SEQ ID NO: 166422 - RNA, 1701 nt, Artificial Sequence; identical to SEQ ID NO: 155189
  derived and/or modified sequence opt4 from hemagglutinin__InfluenzaA__EPI177400

SEQ ID NO: 166423 - RNA, 1701 nt, Artificial Sequence; identical to SEQ ID NO: 155632
  derived and/or modified sequence opt4 from hemagglutinin__InfluenzaA__ACT36512

SEQ ID NO: 166424 - RNA, 1704 nt, Artificial Sequence
  derived and/or modified sequence opt4 from hemagglutinin__InfluenzaA__AJE30344
auggagaagaucgugcugcugcuggccgugaucagccuggugaagagcgaccagaucugcaucggcuaccacgccaacaacagcaccaagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaaccccaugugcgacgaguucaucagagugcccgaguggagcuacaucguggagagagccaaccccgccaacgaccugugcuaccccggcacccugaacgacuacgaggagcugaagcaccugcugagcagaaucaaccacuucgagaagaaccugaucauccccagaagcagcuggcccaaccacgagaccagccugggcgugagcgccgccugccccuaccagggcgccagcagcuucuucagaaacgugguguggcugaucaagaagaacgacgccuaccccaccaucaagaucagcuacaacaacaccaacagagaggaccugcugauccuguggggcauccaccacagcaacaacgccgccgagcagaccaaccuguacaagaaccccgacaccuacgugagcgugggcaccagcacccugaaccagagacuggugcccaagaucgccaccagaagccaggugaacggccagagcggcagaauggacuucuucuggaccauccugaagcccaacgacgccauccacuucgagagcaacggcaacuucaucgcccccgaguacgccuacaagaucgugaagaagggcgacagcaccaucaugaagagcgagauggaguacggccacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuaccccaaguacagcgaggaggccauccugaagagagaggagaucagcggcgugaagcuggagagcaucggcaccuaccagauccugagcaucuacagcaccguggccagcagccuggcccuggccaucaucguggccggccugagccuguggaugugcagcaacggcagccugcagugcagaaucugcaucuga

SEQ ID NO: 166425 - RNA, 1701 nt, Artificial Sequence; identical to SEQ ID NO: 166404
  derived and/or modified sequence opt4 from hemagglutinin__InfluenzaA__EPI178948

SEQ ID NO: 166426 - RNA, 1701 nt, Artificial Sequence; identical to SEQ ID NO: 166404
  derived and/or modified sequence opt4 from hemagglutinin__InfluenzaA__EPI178949

SEQ ID NO: 166427 - RNA, 1701 nt, Artificial Sequence
  derived and/or modified sequence opt4 from hemagglutinin__InfluenzaA__EPI590132
augaaggccauccugaucgugcugcuguacaccuucaccaccgccaacgccgacaagaucugcaucggcuaccacgccaacaacagcaccgacaccguggacaccgugcuggagaagaacgugaccgugacccacagcgugaaccugcuggagaacaagcacaacggcaagcugugcaagcugagaggcguggccccccugcaccugggcaagugcaacaucgccggcuggcugcugggcaaccccgagugcgagagccuggccaccgccagcagcuggagcuacaucguggagaccagcagcagcaacaacggcaccugcuaccccggcgacuucaucaacuacgaggagcugagagagcagcugagcagcgugagcagcuucgagaaguucgagaucuuccccaagaccagcagcuggcccaaccacgagaccaacaagggcgugaccgccgccugcccccacgccggcaccaacagcuucuacaagaaccugaucuggcuggugaagaaggagaacagcuaccccaagaucaacaucagcuacaccaacaacagaggcaaggaggugcuggugcugugggccauccaccacccccccaccagcaccgaccagcagagccuguaccagaacgccaacagcuacguguucgugggcagcagcagauacagcagaaaguucgagcccgagaucgccaccagacccaaggugagaggccaggccggcagaaugaacuacuacuggacccugguggagcccggcgacaagaucaccuucgaggccaccggcaaccugguggugcccagauacgccuucgcccugaagagaaacagcggcagcggcaucaucaucagcgagacccccgugcacgacugcgacaccaccugccagacccccaacggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucagccaccuggagagaagaaucgagaaccugaacaagaagguggacgacggcuucaucgacaucuggaccuacaacgccgagcugcuggugcugcuggagaacgagagaacccuggacuaccacgacagcaacgugaagacccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggaggccaagcugaacagagaggagaucgacggcaucaagcuggagagcaccagaaucuaccagauccuggccaucuacagcaccguggccagcagccuggugcugguggugagccugggcgccaucagcuucuggaugugcagcaacggcagccugcagugcagagugugcaucuga

SEQ ID NO: 166428 - RNA, 1701 nt, Artificial Sequence; identical to SEQ ID NO: 154256
  derived and/or modified sequence opt4 from hemagglutinin__InfluenzaA__ABU80400

SEQ ID NO: 166429 - RNA, 1698 nt, Artificial Sequence
  derived and/or modified sequence opt4 from hemagglutinin__InfluenzaA__ABO21709
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacaaccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 166430 - RNA, 1701 nt, Artificial Sequence; identical to SEQ ID NO: 155176
  derived and/or modified sequence opt4 from hemagglutinin__InfluenzaA__CAZ65588

SEQ ID NO: 166431 - RNA, 1701 nt, Artificial Sequence; identical to SEQ ID NO: 166206
  derived and/or modified sequence opt4 from hemagglutinin__InfluenzaA__EPI697744

SEQ ID NO: 166432 - RNA, 1701 nt, Artificial Sequence; identical to SEQ ID NO: 166366
  derived and/or modified sequence opt4 from hemagglutinin__InfluenzaA__EPI768525

SEQ ID NO: 166433 - RNA, 1701 nt, Artificial Sequence
  derived and/or modified sequence opt4 from hemagglutinin__InfluenzaA__EPI726930
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccaaccacgacagcaacaagggcgugaccgccgccugcccccacgccggcgccaagagcuucuacaagaaccugaucuggcuggugaagaagggcaacagcuaccccaagcugaaccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaccagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166434 - RNA, 1701 nt, Artificial Sequence
  derived and/or modified sequence opt4 from hemagglutinin__InfluenzaA__EPI813817
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccaaccacgacagcaacaagggcgugaccgccgccugcccccacgccggcgccaagagcuucuacaagaaccugaucuggcuggugaagaagggcaacagcuaccccaagcugaaccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaccagacccaaggugagagaccaggaggccagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166435 - RNA, 1701 nt, Artificial Sequence
  derived and/or modified sequence opt4 from hemagglutinin__InfluenzaA__EPI466626
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagcguggugcugguggugagccugggcgccaucagcuucuggaugugcagcaacggcagccugcagugcagaaucugcaucuga

SEQ ID NO: 166436 - RNA, 1701 nt, Artificial Sequence
  derived and/or modified sequence opt4 from hemagglutinin__InfluenzaA__EPI541966
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgagagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagcguggugcugguggugagccugggcgccaucagcuucuggaugugcagcaacggcagccugcagugcagaaucugcaucuga

SEQ ID NO: 166437 - RNA, 1701 nt, Artificial Sequence
  derived and/or modified sequence opt4 from hemagglutinin__InfluenzaA__EPI652003
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgagagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccacccccccaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagcguggugcugguggugagccugggcgccaucagcuucuggaugugcagcaacggcagccugcagugcagaaucugcaucuga

SEQ ID NO: 166438 - RNA, 1701 nt, Artificial Sequence
  derived and/or modified sequence opt4 from hemagglutinin__InfluenzaA__EPI291877
augaaggccaucaucguggugcugcuguacaccuucgccaccgccgacgccgacacccugugcaucggcuaccacgccaacaacagcaccgacaccguggacaccgugcuggagaagaacgugaccgugacccacagcgugaacauccuggagaacaagcacgacggcaagcugugcaagcugagaggcguggccccccugcaccugggcaagugcaacaucgccggcuggcugcugggcaaccccgagugcgagagccuguucgccgccagcagcuggagcuacaucguggagacccccaacagcgacaacggcaccugcuaccccggcgacuucaucaacuacgaggagcugagagagcaccugagcagcgugagcagcuucgagagauucgagaucuuccccaaggccaacagcuggcccaaccacgacaccaacaagggcgugaccgccgccugccccuacgccggcgccaacagcuucuacagaaaccugaucuggcuggugaagaagggcaacagcuaccccaagcugagcaagagcuacaucaacaacaagaagaaggaggugcuggugaucuggggcauccaccacccccccaccagcaucgaccagcagacccuguaccagaacgccgacgccuacguguucgugggcagcagcaaguacagcaagagauucaagcccgagaucgccgccagacccaaggugagagaccaggccggcagaauggacuacuacuggacccugaucgagcccggcgacaccaucaccuucgaggccaccggcaaccugguggugcccagauacgccuucgccaugaagagaggcagcggcagcggcaucaucgugagcgacgcccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcaucaucgagaagaugaacacccaguucaccgccgugggcaaggaguucagccagcuggagaagagaaucgagagccugaacaacaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcaucaagcuggagagcgccagaaucuaccagauccuggccaucuacagcaccguggccagcagccuggugcugcuggugagccugggcgccgugagcuucuggaugugcagcaacggcagccugcagugcagaaucugcaucuga

SEQ ID NO: 166439 - RNA, 1701 nt, Artificial Sequence
  derived and/or modified sequence opt4 from hemagglutinin__InfluenzaA__ABR29595
augaaggccauccugcuggugcugcuguacaccuucaccgccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugagaggcguggccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccaaccacgagaccaacagaggcgugaccgccgccugccccuacgccggcgccaacagcuucuacagaaaccugaucuggcuggugaagaagggcaacagcuaccccaagcugagcaagagcuacgugaacaacaaggagaaggaggugcuggugcuguggggcauccaccacccccccaccagcaccgaccagcagagccuguaccagaacgccgacgccuacguguucgugggcagcagcaaguacaacaagaaguucaagcccgagaucgccaccagacccaaggugagaggccaggccggcagaaugaacuacuacuggacccugguggagcccggcgacaccaucaccuucgaggccaccggcaaccugguggugcccagauacgccuucgccaugaagagaggcagcggcagcggcaucaucaucagcgacacccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 166440 - RNA, 1701 nt, Artificial Sequence
  derived and/or modified sequence opt4 from hemagglutinin__InfluenzaA__EPI291885
augaaggccaucaucguggugcugcugcacaccuucgccaccgccgacgccgacacccugugcaucggcuaccacgccaacaacagcaccgacaccguggacaccgugcuggagaagaacgugaccgugacccacagcgugaaccugcuggagaccaagcacgacggcaagcugugcaaccugaagggcguggccccccugcaccugggcaagugcaacaucgccggcuggcugcugggcaaccccgagugcgagagccuguucaccgccagcagcuggagcuacaucguggagacccccaacagcgacaacggcaccugcuaccccggcaacuucaucaacuacgaggagcugagagagcaccugagcagcgugagcagcuucgagagauucgagaucuuccccaaggccaacagcuggcccaaccacgacaccaacaagggcgugaccgccgccugccccuacgccggcgccaacagcuucuacagaaaccugaucuggcuggugaagaagggcaacagcuaccccaagcugagcaagagcuacaucaacaacaagaagaaggaggugcuggugaucuggggcauccaccacccccccaccagcaccgaccagcagacccuguaccagaacgccgacgccuacguguucgugggcagcagcaaguacagcaagagauucgagcccgagaucgccgccagacccaaggugagaaaccaggccggcagaaugaacuacuacuggacccugaucgagcccggcgacaccaucaccuucgaggccaccggcaaccugguggugcccagauacgccuucgccaugagaagaggcagcggcagcggcaucaucgugagcgacgcccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuuccuggagggcggcuggaccggcaugaucgacggcugguacggcuaccaccaccagaacgagcagggcagcggcuacgccgccgaccagaagagcacccagaacgccaucgacggcaucaccaacaaggugaacagcaucaucgagaagaugaacacccaguucaccgccgugggcaaggaguucagccagcuggagaagagaaucgagagccugaacaacaagguggacgacggcuuccuggacaucuggaccuacaacgccgagaugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcgccagaaucuaccagauccuggccaucuacagcaccguggccagcagccuggugcugcuggugagccugggcgccgugagcuucuggaugugcagcaacggcagccugcagugcagaaucugcaucuga

SEQ ID NO: 166441 - RNA, 1701 nt, Artificial Sequence; identical to SEQ ID NO: 155176
  derived and/or modified sequence opt4 from hemagglutinin__InfluenzaA__EPI176515

SEQ ID NO: 166442 - RNA, 1701 nt, Artificial Sequence; identical to SEQ ID NO: 155632
  derived and/or modified sequence opt4 from hemagglutinin__InfluenzaA__EPI189182

SEQ ID NO: 166443 - RNA, 1701 nt, Artificial Sequence; identical to SEQ ID NO: 155424
  derived and/or modified sequence opt4 from hemagglutinin__InfluenzaA__EPI180574

SEQ ID NO: 166444 - RNA, 1701 nt, Artificial Sequence; identical to SEQ ID NO: 161229
  derived and/or modified sequence opt4 from hemagglutinin__InfluenzaA__EPI377499

SEQ ID NO: 166445 - RNA, 1701 nt, Artificial Sequence
  derived and/or modified sequence opt4 from hemagglutinin__InfluenzaA__EPI346916
augaaggccauccugguggugcugcuguacaccuucaccaccgccaccgccgacacccugugcaucggcuaccacgccaacaacagcaccgacaccguggacaccgugcuggagaagaacgugaccgugacccacagcgugaaccugcuggagaacagacacaacggcaagcugugcaagcugagaggcguggccccccugcaccugggcaagugcaacaucgccggcuggcugcugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacaccaacagaggcgugaccgccgccugcccccacgacggcaccaacagcuucuacagaaaccugaucuggcuggugaagaagggcaacagcuaccccaagaucaacaagagcuacaucaacaacaaggagaaggagauccuggugcugugggccauccaccaccccagcaccagcgccgaccagcagagccuguaccagaacgccgacgccuacguguucgugggcagcagcagauacagcagaaaguucgagcccgagguggccaccagacccaaggugagagaccaggccggcagaaugaacuacuacuggacccugguggagcccggcgacaagaucaccuucgaggccaccggcaaccugguggugcccagauacgccuucgcccugaagagaaacagcggcagcggcaucaucaucagcgacaccagcgugcacgacugcgacaccaacugccagacccccaacggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucagccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaugugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 166446 - RNA, 1689 nt, Artificial Sequence; identical to SEQ ID NO: 155803
  derived and/or modified sequence opt4 from hemagglutinin__InfluenzaA__ACV49600

SEQ ID NO: 166447 - RNA, 1701 nt, Artificial Sequence; identical to SEQ ID NO: 154849
  derived and/or modified sequence opt4 from hemagglutinin__InfluenzaA__BAF48361

SEQ ID NO: 166448 - RNA, 1701 nt, Artificial Sequence
  derived and/or modified sequence opt4 from hemagglutinin__InfluenzaA__EPI507594
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaggcagcaacagcagcuucuucagcagacugaacuggcugacccaccugaacuucaaguaccccgcccugaacgugaccaugcccaacaacgagcaguucgacaagcuguacaucuggggcgugcaccaccccgugaccgacaaggaccagaucuuccuguacgcccagagcagcggcagaaucaccgugagcaccaagagaagccagcaggccgugauccccaacaucggcuucagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacuucgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166449 - RNA, 1701 nt, Artificial Sequence
  derived and/or modified sequence opt4 from hemagglutinin__InfluenzaA__EPI461953
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacuucgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166450 - RNA, 1701 nt, Artificial Sequence
  derived and/or modified sequence opt4 from hemagglutinin__InfluenzaA__EPI461953/m1
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaggcagcaacagcagcuucuucagcagacugaacuggcugacccaccugaacuucaaguaccccgcccugaacgugaccaugcccaacaacgagcaguucgacaagcuguacaucuggggcgugcaccaccccgugaccgacaaggaccagaucuuccuguacgcccagagcagcggcagaaucaccgugagcaccaagagaagccagcaggccgugauccccaacaucggcuacagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacuucgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166451 - RNA, 1701 nt, Artificial Sequence
  derived and/or modified sequence opt4 from hemagglutinin__InfluenzaA__EPI668105
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaggcagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccccuacgcccagagcagcggcagaaucaccgugagcaccaagagaagccagcaggccgugauccccaacaucggcagcagacccagaaucagaggcauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166452 - RNA, 1701 nt, Artificial Sequence
  derived and/or modified sequence opt4 from hemagglutinin__InfluenzaA__EPI578446
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccccuacgcccagagcagcggcagaaucaccgugagcaccaagagaagccagcaggccgugauccccaacaucggcagcagacccagaaucagaggcauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166453 - RNA, 1701 nt, Artificial Sequence; identical to SEQ ID NO: 164961
  derived and/or modified sequence opt4 from hemagglutinin__InfluenzaA__EPI551882

SEQ ID NO: 166454 - RNA, 1701 nt, Artificial Sequence
  derived and/or modified sequence opt4 from hemagglutinin__InfluenzaA__EPI344389
augaagaccaucaucgccuucagcugcauccugugccugaucuucgcccagaagcugcccggcagcgacaacagcauggccacccugugccugggccaccacgccgugcccaacggcacccuggugaagaccaucaccgacgaccagaucgaggugaccaacgccaccgagcuggugcagagcagcagcaccggcagaaucugcaacagcccccaccagauccuggacggcaagaacugcacccugaucgacgcccugcugggcgacccccacugcgacgaccugcagaacaaggagugggaccuguucguggagagaagcaccgccuacagcaacugcuaccccuacuacgugcccgacuacgccacccugagaagccugguggccagcagcggcaaccuggaguucacccaggagagcuucaacuggaccggcguggcccaggacggcagcagcuacgccugcagaagaggcagcgugaacagcuucuucagcagacugaacuggcuguacaaccugaacuacaaguaccccgagcagaacgugaccaugcccaacaacgacaaguucgacaagcuguacaucuggggcgugcaccaccccggcaccgacaaggaccagaccaaccuguacgugcaggccagcggcagagugaucgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagauccagagcggcaagagcagcaucaugagaagcgacgcccacaucgacgagugcaacagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaccggcaagcugaacagagugaucaagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugagcaagcuguucgagagaaccagaagacagcugagagagaacgccgaggacaugggcaacggcugcuucaagaucuaccacaagugcgacaacgccugcaucggcagcaucagaaacggcaccuacgaccacgacaucuacagaaacgaggcccugaacaacagauuccagaucaagggcgugcagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 166455 - RNA, 1701 nt, Artificial Sequence
  derived and/or modified sequence opt4 from hemagglutinin__InfluenzaA__EPI348782
augaagaccaucaucgccuucagcugcauccugugccugaucuucgcccagaagcugcccggcagcgacaacagcauggccacccugugccugggccaccacgccgugcccaacggcacccuggugaagaccaucaccgacgaccagaucgaggugaccaacgccaccgagcuggugcagagcagcagcaccggcagaaucugcaacagcccccaccagauccuggacggcaagaacugcacccugaucgacgcccugcugggcgacccccacugcgacgaccugcagaacaaggagugggaccuguucguggagagaagcaccgccuacagcaacugcuaccccuacuacgugcccgacuacgccacccugagaagccugguggccagcagcggcaaccuggaguucacccaggagagcuucaacuggaccggcguggcccaggacggcagcagcuacgccugcagaagaggcagcgugaacagcuucuucagcagacugaacuggcuguacaagcugaacuacaaguaccccgagcagaacgugaccaugcccaacaacgacaaguucgacaagcuguacaucuggggcgugcaccaccccggcaccgacaaggaccagaccaacaucuacgugcaggccagcggcagagugaucgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagauccagagcggcaagagcagcaucaugagaagcgacgcccacaucgacgagugcaacagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaccggcaagcugaacagagugaucaagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugagcaagcuguucgagagaaccagaagacagcugagagagaacgccgaggacaugggcaacggcugcuucaagaucuaccacaagugcgacaacgccugcaucggcagcaucagaaacggcaccuacgaccacgacaucuacagaaacgaggcccugaacaacagauuccagaucaagggcgugcagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 166456 - RNA, 1701 nt, Artificial Sequence
  derived and/or modified sequence opt4 from hemagglutinin__InfluenzaA__EPI642513
augaagaccaucaucgccuucagcugcauccugugccugaucuucgcccagaagcugcccggcagcgacaagagcauggccacccugugccugggccaccacgccgugcccaacggcacccuggugaagaccaucaccgacgaccagaucgaggugaccaacgccaccgagcuggugcagagcagcagcaccagcagaaucugcaacagcccccaccagauccuggacggcaagaacugcacccugaucgacgcccugcugggcgacccccacugcgacgacuuccagaacaagaagugggaccuguucguggagagaagcaccgccuacagcaacugcuaccccuacuacgugcccgacuacgccacccugagaagccugaucgccagcagcggcaaccuggaguucacccaggagagcuucaacuggaccggcguggcccaggacggcagcagcuacgccugcagaagaggcagcgugaacagcuucuucagcagacugaacuggcuguacaaccugaacuacaaguaccccgagcagaacgugaccaugcccaacaacgacaaguucgacaagcuguacaucuggggcgugcaccaccccggcaccgacaaggaccagaccaaccuguacgugcaggccagcggcagagugaucgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagauccagagcggcaagagcagcaucaugagaagcgacgcccacaucgacgagugcaacagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaccggcaagcugaacagagugaucaagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugagcaagcuguucgagagaaccagaagacagcugagagagaacgccgaggacaugggcaacggcugcuucaagaucuaccacaagugcgacaacgccugcaucggcagcaucagaaacggcaccuacgaccacgacaucuacagaaacgaggcccugaacaacagauuccagaucaagggcgugcagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 166457 - RNA, 1701 nt, Artificial Sequence
  derived and/or modified sequence opt4 from hemagglutinin__InfluenzaA__EPI293965
augaagaccaucaucgccuucagcugcauccugugccugaucuucgcccagaagcugcccggcagcgacaacagcauggccacccugugccugggccaccacgccgugcccaacggcacccuggugaagaccaucaccgacgaccagaucgaggugaccaacgccaccgagcuggugcagagcagcagcaccggcagaaucugcaacagcccccaccagauccuggacggcaagaacugcacccugaucgacgcccugcugggcgacccccacugcgacgacuuccagaacaaggagugggaccuguucguggagagaagcaccgccuacagcaacugcuaccccuacuacgugcccgacuacgccacccugagaagccugguggccagcagcggcaaccuggaguucacccaggagagcuucaacuggaccggcguggcccaggacggcagcagcuacgccugcagaagaggcagcgugaacagcuucuucagcagacugaacuggcuguacaaccugaacuacaaguaccccgagcagaacgugaccaugcccaacaacgacaaguucgacaagcuguacaucuggggcgugcaccaccccggcaccgacaaggaccagaccaaccuguacgugcaggccagcggcagagugaucgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagauccagagcggcaagagcagcaucaugagaagcgacgcccacaucgacgagugcaacagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaccggcaagcugaacagagugaucaagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugagcaagcuguucgagagaaccagaagacagcugagagagaacgccgaggacaugggcaacggcugcuucaagaucuaccacaagugcgacaacgccugcaucggcagcaucagaaacggcaccuacgaccacgacaucuacagaaacgaggcccugaacaacagauuccagaucaagggcgugcagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 166458 - RNA, 1701 nt, Artificial Sequence
  derived and/or modified sequence opt4 from hemagglutinin__InfluenzaA__EPI465400
augaagaccaucaucgccuucagcugcauccugugccugaucuucgcccagaagcugcccggcagcgacaacagcauggccacccugugccugggccaccacgccgugcccaacggcacccuggugaagaccaucaccgacgaccagaucgaggugaccaacgccaccgagcuggugcagagcagcagcaccggcagaaucugcaacagcccccaccagauccuggacggcaagaacugcacccugaucgacgcccugcugggcgacccccacugcgacgacuuccagaacaaggagugggaccuguucguggagagaagcaccgccuacagcaacugcuaccccuacuacgugcccgacuacgccacccugagaagccugguggccagcagcggcaaccuggaguucacccaggagagcuucaacuggaccggcguggcccaggacggcagcagcuacgccugcagaagaggcagcgugaacagcuucuucagcagacugaacuggcuguacaaccugaacuacaaguaccccgagcagaacgugaccaugcccaacaacgacaaguucgacaagcuguacaucuggggcgugcaccaccccggcaccgacaaggaccagaccaagcuguacgugcaggccagcggcagagugaucgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagauccagagcggcaagagcagcaucaugagaagcgacgcccacaucgacgagugcaacagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaccggcaagcugaacagagugaucaagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugagcaagcuguucgagagaaccagaagacagcugagagagaacgccgaggacaugggcaacggcugcuucaagaucuaccacaagugcgacaacgccugcaucggcagcaucagaaacggcaccuacgaccacgacaucuacagaaacgaggcccugaacaacagauuccagaucaagggcgugcagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 166459 - RNA, 1701 nt, Artificial Sequence
  derived and/or modified sequence opt4 from hemagglutinin__InfluenzaA__EPI328898
augaagaccaucaucgccuucagcugcauccugugccugaucuucgcccagaagcugcccggcagcgacaacagcauggccacccugugccugggccaccacgccgugcccaacggcacccuggugaagaccaucaccgacgaccagaucgaggugaccaacgccaccgagcuggugcagagcagcagcaccggcagaaucugcaacagcccccaccagauccuggacggcaagaacugcacccugaucgacgcccugcugggcgacccccacugcgacgacuuccagaacaaggagugggaccuguucguggagagaagcaccgccuacagcaacugcuaccccuacuacgugcccgacuacgccacccugagaagccugguggccagcagcggcaaccuggaguucacccaggagagcuucaacuggaccggcguggcccaggacggcagcagcuacgccugcagaagaggcagcgugaacagcuucuucagcagacugaacuggcuguacaaccugaacuacaaguaccccgagcagaacgugaccaugcccaacaacgacaaguucgacaagcuguacaucuggggcgugcaccaccccggcaccgacaaggaccagaccaagaucuacgugcaggccagcggcagagugaucgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagauccagagcggcaagagcagcaucaugagaagcgacgcccacaucgacgagugcaacagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaccggcaagcugaacagagugaucaagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugagcaagcuguucgagagaaccagaagacagcugagagagaacgccgaggacaugggcaacggcugcuucaagaucuaccacaagugcgacaacgccugcaucggcagcaucagaaacggcaccuacgaccacgacaucuacagaaacgaggcccugaacaacagauuccagaucaagggcgugcagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 166460 - RNA, 1701 nt, Artificial Sequence; identical to SEQ ID NO: 166459
  derived and/or modified sequence opt4 from hemagglutinin__InfluenzaA__EPI328900

SEQ ID NO: 166461 - RNA, 1701 nt, Artificial Sequence
  derived and/or modified sequence opt4 from hemagglutinin__InfluenzaA__EPI574644
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcaagaacugcacccugaucgacgcccugcugggcgacccccagugcgacggcuuccagaacaagagaugggaccuguucguggagagaagcaaggccuacagcaacugcuaccccuacgacgugcccgacuacgccagccugagaagccugguggccagcagcggcacccuggaguucaacgacgagagcuucaacugggccggcgugacccagaacggcaccagcagcgccugcaucagaggcagcaacagcagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccacagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166462 - RNA, 1701 nt, Artificial Sequence
  derived and/or modified sequence opt4 from hemagglutinin__InfluenzaA__EPI563212
augaagaccaucaucgcccugagcuacauccugugccugguguucgcccagaagauccccggcaacgacaacaacaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccccuacgcccagagcagcggcagaaucaccgugagcaccaagagaagccagcaggccgugauccccaacaucggcagcagacccagaaucagaggcauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166463 - RNA, 1701 nt, Artificial Sequence; identical to SEQ ID NO: 166462
  derived and/or modified sequence opt4 from hemagglutinin__InfluenzaA__EPI553999

SEQ ID NO: 166464 - RNA, 1701 nt, Artificial Sequence
  derived and/or modified sequence opt4 from hemagglutinin__InfluenzaA__EPI551570
augaagaccaucaucgcccugagcuacauccugugccugguguucgcccagaagauccccggcaacgacaacaacaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaccuaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166465 - RNA, 1701 nt, Artificial Sequence
  derived and/or modified sequence opt4 from hemagglutinin__InfluenzaA__EPI629738
augaagaccaucaucgcccugagcuacauccugugccugguguucgcccagaagauccccggcaacgacaacaacaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccccuacgcccagagcagcggcagaaucaucgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166466 - RNA, 1701 nt, Artificial Sequence
  derived and/or modified sequence opt4 from hemagglutinin__InfluenzaA__EPI631887
augaagaccaucaucgcccugagcuacauccugugccugguguucgcccagaagauccccggcaacgacaacaacaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccccuacgcccagagcagcggcagaaucaucgugagcaccaagagaagccagcaggccgugauccccaacaucggcagcagacccagaaucagagacagccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166467 - RNA, 1701 nt, Artificial Sequence
  derived and/or modified sequence opt4 from hemagglutinin__InfluenzaA__EPI577026
augaagaccaucaucgcccugagcuacauccugugccugguguucgcccagaagauccccggcaacgacaacaacaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccccuacgcccagagcagcggcagaaucaccgugagcaccaagagaagccagcaggccgugauccccaacaucggcagcagacccagaaucagaggcauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucgagagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166468 - RNA, 1701 nt, Artificial Sequence; identical to SEQ ID NO: 162514
  derived and/or modified sequence opt4 from hemagglutinin__InfluenzaA__EPI404927

SEQ ID NO: 166469 - RNA, 1701 nt, Artificial Sequence
  derived and/or modified sequence opt4 from hemagglutinin__InfluenzaA__EPI489319
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccccuacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166470 - RNA, 1701 nt, Artificial Sequence; identical to SEQ ID NO: 164947
  derived and/or modified sequence opt4 from hemagglutinin__InfluenzaA__EPI530647

SEQ ID NO: 166471 - RNA, 1701 nt, Artificial Sequence; identical to SEQ ID NO: 164961
  derived and/or modified sequence opt4 from hemagglutinin__InfluenzaA__EPI541083

SEQ ID NO: 166472 - RNA, 1701 nt, Artificial Sequence
  derived and/or modified sequence opt4 from hemagglutinin__InfluenzaA__EPI684315
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccccuacgcccagagcagcggcagaaucaucgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166473 - RNA, 1701 nt, Artificial Sequence
  derived and/or modified sequence opt4 from hemagglutinin__InfluenzaA__EPI614462
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccagaagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166474 - RNA, 1701 nt, Artificial Sequence
  derived and/or modified sequence opt4 from hemagglutinin__InfluenzaA__EPI541465
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacaacagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccagaagaagccagcaggccgugauccccaacaucggcagcagacccagaaucagaggcauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166475 - RNA, 1701 nt, Artificial Sequence
  derived and/or modified sequence opt4 from hemagglutinin__InfluenzaA__EPI696967
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugaccagacugaacagcaaguaccccgcccugaacgugaccaugcccaacaacgagcaguucgacaagcuguacaucuggggcgugcaccaccccgagaccgacaaggaccagaucuuccuguacgcccagagcagcggcagaaucaccgugagcaccagaagaagccagcaggccgugauccccaacaucggcagcagacccagaaucagaggcauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166476 - RNA, 1701 nt, Artificial Sequence
  derived and/or modified sequence opt4 from hemagglutinin__InfluenzaA__EPI674597
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacaacagcuucuucagcagacugaacuggcugacccaccugaacagcaaguaccccgcccugaacgugaccaugcccaacaacgagcaguucgacaagcuguacaucuggggcgugcaccaccccgugaccgacaaggaccagaucuuccuguacgcccagagcagcggcagaaucaccgugagcaccagaagaagccagcaggccgugauccccaacaucggcagcagacccagaaucagaggcauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166477 - RNA, 1701 nt, Artificial Sequence
  derived and/or modified sequence opt4 from hemagglutinin__InfluenzaA__EPI530677
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacagcaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166478 - RNA, 1701 nt, Artificial Sequence
  derived and/or modified sequence opt4 from hemagglutinin__InfluenzaA__EPI530679
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcaucagaggcagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166479 - RNA, 1701 nt, Artificial Sequence; identical to SEQ ID NO: 152542
  derived and/or modified sequence opt4 from hemagglutinin__InfluenzaA__AAG01785

SEQ ID NO: 166480 - RNA, 1701 nt, Artificial Sequence; identical to SEQ ID NO: 164947
  derived and/or modified sequence opt4 from hemagglutinin__InfluenzaA__EPI814528

SEQ ID NO: 166481 - RNA, 1701 nt, Artificial Sequence
  derived and/or modified sequence opt4 from hemagglutinin__InfluenzaA__EPI674736
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcagaagaggcagcaacagcagcuucuucagcagacugaacuggcugacccaccugaacagcaaguaccccgcccugaacgugaccaugcccaacaacgagcaguucgacaagcuguacaucuggggcgugcaccaccccgugaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166482 - RNA, 1701 nt, Artificial Sequence; identical to SEQ ID NO: 164947
  derived and/or modified sequence opt4 from hemagglutinin__InfluenzaA__EPI614444

SEQ ID NO: 166483 - RNA, 1701 nt, Artificial Sequence
  derived and/or modified sequence opt4 from hemagglutinin__InfluenzaA__EPI551814
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcagaagaggcagcaacagcagcuucuucagcagacugaacuggcugaccagacugaacagcaaguaccccgcccugaacgugaccaugcccaacaacgagcaguucgacaagcuguacaucuggggcgugcaccaccccgugaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166484 - RNA, 1701 nt, Artificial Sequence
  derived and/or modified sequence opt4 from hemagglutinin__InfluenzaA__EPI696955
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcagaagaggcagcaacagcagcuucuucagcagacugaacuggcugacccaccugaacagcaaguaccccgcccugaacgugaccaugcccaacaacgagcaguucgacaagcuguacaucuggggcgugcaccaccccgugaccgacaaggaccagaucuuccuguacgcccagagcagcggcagaaucaccgugagcaccaagagaagccagcaggccgugauccccaacaucggcuacagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166485 - RNA, 1701 nt, Artificial Sequence
  derived and/or modified sequence opt4 from hemagglutinin__InfluenzaA__EPI740790
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcagcugcagaagaggcagcaacagcagcuucuucagcagacugaacuggcugacccaccugaacagcaaguaccccgcccugaacgugaccaugcccaacaacgagcaguucgacaagcuguacaucuggggcgugcaccaccccgugaccgacaaggaccagaucuuccuguacgcccagagcagcggcagaaucaccgugagcaccaagagaagccagcaggccgugauccccaacaucggcuucagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166486 - RNA, 1701 nt, Artificial Sequence; identical to SEQ ID NO: 161229
  derived and/or modified sequence opt4 from hemagglutinin__InfluenzaA__EPI377499

SEQ ID NO: 166487 - RNA, 1701 nt, Artificial Sequence
  derived and/or modified sequence opt4 from hemagglutinin__InfluenzaA__EPI391247
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaacggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccgugaccgacaaggaccagaucuuccuguacgcccagcccagcggcagaaucaccgugagcaccaagagaagccagcaggccgugauccccaacaucggcuucagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166488 - RNA, 1701 nt, Artificial Sequence
  derived and/or modified sequence opt4 from hemagglutinin__InfluenzaA__EPI407123
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaacggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccgugaccgacaaggaccagaucuuccuguacgcccagcccagcggcagaaucaccgugagcaccaagagaagccagcaggccgugauccccaacaucggcuucagacccagaaucagaaacaaccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcgagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166489 - RNA, 1701 nt, Artificial Sequence
  derived and/or modified sequence opt4 from hemagglutinin__InfluenzaA__EPI407126
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaacggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccgugaccgacaaggaccagaucuuccuguacgcccagcccagcggcagaaucaccgugagcaccaagagaagccagcaggccgugauccccaacaucggcuucagacccagaaucagaaacaaccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166490 - RNA, 1701 nt, Artificial Sequence; identical to SEQ ID NO: 166375
  derived and/or modified sequence opt4 from hemagglutinin__InfluenzaA__EPI562037

SEQ ID NO: 166491 - RNA, 1701 nt, Artificial Sequence; identical to SEQ ID NO: 164961
  derived and/or modified sequence opt4 from hemagglutinin__InfluenzaA__EPI562034

SEQ ID NO: 166492 - RNA, 1701 nt, Artificial Sequence
  derived and/or modified sequence opt4 from hemagglutinin__InfluenzaA__EPI653140
augaagaccaucaucgcccugagcuacauccugugccugguguucgcccagaagauccccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcagcugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcagcagcuucuucagcagacugaacuggcugacccaccugaacuacaaguaccccgcccugaacgugaccaugcccaacaacgagcaguucgacaagcuguacaucuggggcgugcaccaccccggcaccgacaaggaccagaucuuccccuacgcccagagcagcggcagaaucaccgugagcaccaagagaagccagcaggccgugauccccaacaucggcagcagacccagaaucagaggcauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcacagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 166493 - RNA, 1707 nt, Artificial Sequence
  derived and/or modified sequence opt4 from hemagglutinin__InfluenzaA__ACR48873/m
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucgagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 166494 - RNA, 1707 nt, Artificial Sequence
  derived and/or modified sequence opt4 from hemagglutinin__InfluenzaA__ACR48874/m
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaaggacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 166495 - RNA, 1701 nt, Artificial Sequence; identical to SEQ ID NO: 161666
  derived and/or modified sequence opt4 from hemagglutinin__InfluenzaA__ACD47234

SEQ ID NO: 166496 - RNA, 1707 nt, Artificial Sequence
  derived and/or modified sequence opt4 from hemagglutinin__InfluenzaA__ACZ36881
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 166497 - RNA, 1704 nt, Artificial Sequence
  derived and/or modified sequence opt4 from hemagglutinin__InfluenzaA__EPI500771
auggagaagaucgugcugcuguucgccaccaucagccuggugaagagcgaccacaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaacccccugugcgacgaguucaccaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaaggacagcuggagcgaccacgaggccagccugggcgugagcgccgccugcagcuaccagggcaacagcagcuucuucagaaacgugguguggcugaucaagaaggacaacgccuaccccaccaucaagaagggcuacaacaacaccaacagagaggaccugcugauccuguggggcauccaccaccccaacgacgaggccgagcagaccaagcuguaccagaaccccaccaccuacaucagcaucggcaccagcacccugaaccagagacuggugcccaagaucgccaccagaagcaagaucaacagacagagcggcagaaucgacuucuucuggaccauccugaagcccaacgacgccauccacuucgagagcaacggcaacuucaucgcccccgaguacgccuacaagaucgugaagaagggcgacagcaccaucaugagaagcgagguggaguacggcaacugcaacaccagaugccagacccccaucggcgccaucaacagcagcaugcccuuccacaacauccacccccugaccaucggcgagugccccaaguacgugaagagcaacaagcuggugcuggccaccggccugagaaacagcccccagagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugaaggacaacgccaaggagcugggcaacggcugcuucgaguucuaccacaagugcaacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggugcuggccaucaugauggccggccugagccuguggaugugcagcaacggcagccugcagugcagaaucugcaucuga

SEQ ID NO: 166498 - RNA, 1695 nt, Artificial Sequence
  derived and/or modified sequence opt4 from hemagglutinin__InfluenzaA__ABF93441
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaagaacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagaucgagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 166499 - RNA, 1707 nt, Artificial Sequence
  derived and/or modified sequence opt4 from hemagglutinin__InfluenzaA__AGG12577
auggagaagaucgugcugcuguucgccaucaucagccuggugaagagcgaccacaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaaccccaugugcgacgaguucaucgacgugcccgaguggagcuacaucguggagaaggccaaccccgccaacgaccugugcuaccccggcaacuucaacgacuacgaggagcugaagcaccugcugagcagaaucaaccacuucgagaagaucagaaucauccccaaggacagcuggcccgaccacgaggccagccugggcgugagcgccgccugcagcuaccagggcaacagcagcuucuucagaaacgugguguggcugcugaagaaggacaacgccuaccccaucaucaagaagagcuacaacaacaccaacaaggaggaccugcuggugcuguggggcauccaccaccccaacgacgaggccgagcagaccagacuguaccagaaccccaccaccuacgugagcaucggcaccagcacccugaaccagagacuggugcccagaaucgccaccagaagcaaggugaacggccagagcggcagaaucgacuucuucuggaccauccugaagcccaacgacgccaucaacuucgagagcaacggcaacuucaucgcccccgaguacgccuacaagaucgugaagaagggcgacagcaccaucaugagaagcgagguggaguacggcaacugcagcaccagaugccagacccccaugggcgccaucaacagcagcaugcccuuccacaacauccacccccugaccaucggcgagugccccaaguacgugaagagcaacaagcuggugcuggccaccggccugagaaacagcccccagaucgagagaagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggugcuggccaucaugguggccggccugagccuguggaugugcagcaacggcagccugcagugcagaaucugcaucuga

SEQ ID NO: 166500 - RNA, 1707 nt, Artificial Sequence; identical to SEQ ID NO: 166499
  derived and/or modified sequence opt4 from hemagglutinin__InfluenzaA__AGC13463

SEQ ID NO: 166501 - RNA, 1707 nt, Artificial Sequence; identical to SEQ ID NO: 158363
  derived and/or modified sequence opt4 from hemagglutinin__InfluenzaA__ACI06178/m1

SEQ ID NO: 166502 - RNA, 1707 nt, Artificial Sequence
  derived and/or modified sequence opt4 from hemagglutinin__InfluenzaA__AHF20402
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugagaccccugauccugagagacugcagcguggccggcuggcugcugggcaaccccaugugcgacgaguucaucaacgugcccgaguggagcuacaucguggagaaggccaaccccgugaacgaccugugcuaccccggcguguucaacgacuacgaggagcugaagcaccugcugagcagaaucaaccacuucgagaagauccagaucauccccaagaacagcuggcccagccacgaggccagccugggcgugagcgccgccugccccuaccagggccagagcagcuucuucagaaacgugguguggcugaucaagaagaacaacaccuaccccaccaucaagagaagcuacaacaacaccaaccaggaggaccugcuggugauguggggcauccaccaccccaacgacgccguggagcagaccaagcuguaccagaaccccaccaccuacaucagcgugggcaccagcacccugaaccagagacugacccccagaaucgccaccagaagcaaggugaagggccugagcggcagaauggaguucuucuggaccauccugaagcccaacgacgccaucaacuucgagagcaacggcaacuucaucgcccccgaguacgccuacaagaucgugaagaagggcgacagcaccaucaugagaagcgagcuggaguacggcaacugcaacaccaagugccagacccccaugggcgccaucaacagcagcaugcccuuccacaacauccacccccugaccaucggcgagugccccaaguacgugaagagcaccagacuggugcuggccaccggccugagaaacagcccccagagagaggagagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacaagugcauggagagcgugagaaacggcaccuacgacuacccccaguacagcgaggaggccagacugaagagagaggagaucagcggcgugaagcuggagagcaucggcguguaccagauccugagcaucuacagcaccguggccagcagccuggcccuggccaucaugguggccggccugagccuguggaugugcagcaacggcagccugcagugcagaaucugcaucuga

SEQ ID NO: 166503 - RNA, 1707 nt, Artificial Sequence
  derived and/or modified sequence opt4 from hemagglutinin__InfluenzaA__ABQ45850
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaagaacgacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 166504 - RNA, 1713 nt, Artificial Sequence
  derived and/or modified sequence opt4 from hemagglutinin__InfluenzaA__AKI82373
auggagaagaucgugccccugcuggccaucaucggccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugaaggacugcagcguggccggcuggcugcugggcaaccccaugugcgacgaguuccugaacgugagcgaguggagcuacaucguggagaaggccagccccgccaacggccugugcuaccccggcgacuucaacgacuacgaggagcugaagcaccugcugaacagaaucacccaccugaagaagaucaagaucauccccaagagcuacuggagcaaccacgaggccagcagcggcgugagcgccgccugcagcuacaugggcgagcccagcuucuucagaaacgugguguggcugaucaagaagaacaacaccuacccccccaucaaggugaacuacaccaacaccaaccaggaggaccugcuggugcuguggggcauccaccaccccaacaacgaggccgagcagauccagaucuaccagaaccugaucacccacaucagcgugggcaccagcacccugaaccagagacugauccccaagaucgccaccagaagcaaggugaacggccagagcggcagaauggaguucuucuggaccauccugaagcccaacgacagcaucaacuucgacagcaacggcaacuucaucgcccccgaguacgccuacaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacgccccccagagagagagagagggcggcagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcaucaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgagaaggugagacugcagcugagagacaacgccaaggagcugggcaacggcugcuucgaguucuaccacaagugcgacaacgagugcauggagagcgugagaaacggcaccuacgacuacagccaguacagcgaggaggccagacugagcagagaggagaucaacggcgugaagcuggagagcauggugaccuaccagauccugagcaucuacagcaccguggccagcagccuggcccuggccaucaugguggccggccugagccuguggaugugcagcaacggcagccugcagugcagaaucugcaucuga

SEQ ID NO: 166505 - RNA, 1713 nt, Artificial Sequence
  derived and/or modified sequence opt4 from hemagglutinin__InfluenzaA__EPI284473
auggagaagaucgugcugcugcuggccaucaucagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugaaggacugcagcguggccggcuggcugcugggcaaccccaugugcgacgaguuccugaacgugagcgaguggagcuacaucguggagaaggccagccccgccaacggccugugcuaccccggcgacuucaacgacuacgaggagcugaagcaccugcugaacagaaucacccaccugaagaagaucaagaucauccccaagagcuacuggagcaaccacgaggccagcagcggcgugagcgccgccugcagcuacaugggcgagcccagcuucuucagaaacgugguguggcugaucaagaagaacaacaccuacccccccaucaaggugaacuacaccaacaccaaccaggaggaccugcuggugcuguggggcauccaccaccccaacaacgaggccgagcagauccagaucuaccagaaccugaucacccacaucagcgugggcaccagcacccugaaccagagacugauccccaagaucgccaccagaagcaaggugaacggccagagcggcagaauggaguucuucuggaccauccugaagcccaacgacagcaucaacuucgacagcaacggcaacuucaucgcccccgaguacgccuacaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacgccccccagagagagagagagggcggcagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcaucaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgagaaggugagacugcagcugagagacaacgccaaggagcugggcaacggcugcuucgaguucuaccacaagugcgacaacgagugcauggagagcgugagaaacggcaccuacgacuacagccaguacagcgaggaggccagacugagcagagaggagaucaacggcgugaagcuggagagcauggugaccuaccagauccugagcaucuacagcaccguggccagcagccuggcccuggccaucaugguggccggccugagccuguggaugugcagcaacggcagccugcagugcagaaucugcaucuga

SEQ ID NO: 166506 - RNA, 1710 nt, Artificial Sequence
  derived and/or modified sequence opt4 from hemagglutinin__InfluenzaA__ACO07033
auggagaagaucgugcugcugcuggccaugaucggccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugaaggacugcagcguggccggcuggcugcugggcaaccccaugugcgacgaguuccugaacgugagcgaguggagcuacaucguggagaaggccagccccgccaacggccugugcuaccccggcgacuucaacgacuacgaggagcugaagcaccugcugagcagaaucaaccaccugaagaagaucaagaucauccccaagagcuacuggagcaaccacgaggccagcagcggcgugagcgccgccugcagcuaccugggcgagcccagcuucuucagaaacgugguguggcugaucaagaagaacaacaccuacccccccaucaaggugaacuacaccaacaccaaccaggaggaccugcuggugcuguggggcauccaccaccccaacgacgagaaggagcagaucagaaucuaccagaaccccaacaccagcaucagcgugggcaccagcacccugaaccagagacuggugcccaagaucgccaccagacccaaggugaacggccagagcggcagaauggaguucuucuggaccauccugaagcccaacgacagcaucaacuucgacagcaacggcaacuucaucgcccccgaguacgccuacaagaucgccaagaagggcgacagcgugaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacgccccccagagagagggcggcagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcaucaccaacaaggugaacagcaucaucgacaagaugaacacccaguucgagaucgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgagaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugagcagagaggagaucagcggcgugaagauggagagcauggugaccuaccagauccugagcaucuacagcaccguggccagcagccuggcccuggccaucaugguggccggccugagccuguggaugugcagcaacggcagccugcagugcagaaucugcaucuga

SEQ ID NO: 166507 - RNA, 1695 nt, Artificial Sequence
  derived and/or modified sequence opt4 from hemagglutinin__InfluenzaA__EPI174803
auggagaagaucgugcugcugcuggccaugaucggccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugaaggacugcagcguggccggcuggcugcugggcaaccccaugugcgacgaguuccugaacgugagcgaguggagcuacaucguggagaaggccagccccgccaacggccugugcuaccccggcgacuucaacgacuacgaggagcugaagcaccugcugagcagaaucaaccaccugaagaagaucaagaucauccccaagagcuacuggagcaaccacgaggccagcagcggcgugagcgccgccugcagcuaccugggcgagcccagcuucuucagaaacgugguguggcugaucaagaagaacaacaccuacccccccaucaaggugaacuacaccaacaccaaccaggaggaccugcuggugcuguggggcauccaccaccccaacgacgagaaggagcagaucagaaucuaccagaaccccaacaccagcaucagcgugggcaccagcacccugaaccagagacuggugcccaagaucgccaccagacccaaggugaacggccagagcggcagaauggaguucuucuggaccauccugaagcccaacgacagcaucaacuucgacagcaacggcaacuucaucgcccccgaguacgccuacaagaucgccaagaagggcgacagcgugaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacgccccccagaccgagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcaucaccaacaaggugaacagcaucaucgacaagaugaacacccaguucgagaucgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgagaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugagcagagaggagaucagcggcgugaagauggagagcauggugaccuaccagauccugagcaucuacagcaccguggccagcagccuggcccuggccaucaugguggccggccugagccuguggaugugcagcaacggcagccugcagugcagaaucugcaucuga

SEQ ID NO: 166508 - RNA, 1704 nt, Artificial Sequence
  derived and/or modified sequence opt4 from hemagglutinin__InfluenzaA__AGZ62382
auggagaagaucgugcugcuguucgccgccaucagccuggugaagagcgaccacaucugcaucggcuaccacgccaacaacagcaccaagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaaccccaugugcgacgaguucaucaacgugcccgaguggagcuacaucguggagaaggccaaccccgccaacggccugugcuaccccggcaacuucaacgacuacgaggagcugaagcaccugcugagcagaaucaaccacuucgagaagaucagaaucauccccaaggacagcuggagcgaccacgaggccagccugggcgugagcgccgccugccccuaccagggcaacagcagcuucuucagaaacgugguguggcugaucaagaaggacaacaccuaccccaccaucaagaagagcuacaacaacaccaaccaggaggaccugcugauccuguggggcauccaccaccccaacgacgaggccgagcagaccagacuguaccagaaccccaccaccuacaucagcaucggcaccagcacccugaaccagagacuggugcccaagaucgccaccagaagcaagaucaacggccagagcggcagaaucgacuucuucuggaccauccugaagcccaacgacgccauccacuucgagagcaacggcaacuucaucgcccccgaguacgccuacaagaucgugaagaagggcgacagcaccaucaugaagagcgagguggaguacggcaacugcaacaccagaugccagacccccaucggcgccaucaacagcagcaugcccuuccacaacauccacccccugaccaucggcgagugccccaaguacgugaagagcaacaagcuggugcuggccaccggccugagaaacagcccccagagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugagaaaccuguacgacaaggugagacugcagcugaaggacaacgccaaggagcugggcaacggcugcuucgaguucuaccacaagugcaacaacgagugcauggagagcgugagaaacggcaccuacgacuacccccaguacagcgaggaggccagacugagaagagaggagaucagcggcgugaagcuggagagcaucggcaucuaccagauccugagcaucuacagcaccguggccagcagccuggugcuggccaucaugauggccggccugagccuguggaugugcagcaacggcagccugcagugcagaaucugcaucuga

SEQ ID NO: 166509 - RNA, 1704 nt, Artificial Sequence
  derived and/or modified sequence opt4 from hemagglutinin__InfluenzaA__ABG67978/m
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaucaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 166510 - RNA, 1695 nt, Artificial Sequence
  derived and/or modified sequence opt4 from hemagglutinin__InfluenzaA__EPI827075
auggagaagaucgugcugcuguucgccaccaucagccuggugaagagcgaccacaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaacccccugugcgacgaguucaccaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaaggacagcuggagcgaccacgaggccagccugggcgugagcgccgccugcagcuaccagggcaacagcagcuucuucagaaacgugguguggcugaucaagaaggacaacgccuaccccaccaucaagaagggcuacaacaacaccaacagagaggaccugcugauccuguggggcauccaccaccccaacgacgaggccgagcagaccagacuguaccagaaccccaccaccuacaucagcaucggcaccagcacccugaaccagagacuggugcccaagaucgccaccagaagcaagaucaacggccagagcggcagaaucgacuucuucuggaccauccugaagcccaacgacgccauccacuucgagagcaacggcaacuucaucgcccccgaguacgccuacaagaucgugaagaagggcgacagcaccaucaugagaagcgagguggaguacggcaacugcaacaccagaugccagacccccaucggcgccaucaacagcagcaugcccuuccacaacauccacccccugaccaucggcgagugccccaaguacgugaagagcaacaagcuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugaaggacaacgccaaggagcugggcaacggcugcuucgaguucuaccacaagugcaacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggugcuggccaucaugauggccggccugagccuguggaugugcagcaacggcagccugcagugcagaaucugcaucuga

SEQ ID NO: 166511 - RNA, 1707 nt, Artificial Sequence
  derived and/or modified sequence opt4 from hemagglutinin__InfluenzaA__ABP96850
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcgacuucaacgacuacgaggagcugaagcaccugcugagcagaaucaaccacuucgagaagauccagaucauccccaagagcagcuggagcgacuacgaggccagcagcggcgugagcagcgccugccccuaccagggcagaagcagcuucuucagaaacgugguguggcugaucaagaagaacaacgccuaccccaccaucaagagaagcuacaacaacaccaaccaggaggaccugcuggugcuguggggcauccaccaccccaacgacgccgccgagcagaucagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucaacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccuguuccuguggaugugcagcaacggcagccugcagugcagaaucugcaucuga

SEQ ID NO: 166512 - RNA, 1692 nt, Artificial Sequence
  derived and/or modified sequence opt4 from hemagglutinin__InfluenzaA__EPI827077
auggagaagaucgugcugcugcuggccaucgugagcaucgugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaaggacagcuggagcgaccacgaggccagcggcgugagcagcgccugccccuaccagggcagaagcagcuucuucagaaacgugguguggcugaccaagaagaacgacgccuaccccaccaucaagaagagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacagcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagagagagaccagaggccuguucggcgccaucgccggcuucaucgagggcggcuggcagggcaugguggacggcugguacggcuaccaccacagcaacgagcagggcagcggcuacgccgccgacaaggagagcacccagagagccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 166513 - RNA, 1704 nt, Artificial Sequence
  derived and/or modified sequence opt4 from hemagglutinin__InfluenzaA__EPI594523
auggagaagaucauccugcugcuggccaucaucggccuggugaagagcgaccagaucugcgugggcuaccacgccaacaacagcaccgagagaguggacaccaucauggagaagaacgugaccgugacccacgcccaggacauccuggagaagacccacaacggcaagcugugcaaccugaacggcgugaagccccugauccuggaggacugcagcguggccggcuggcugcugggcaaccccaugugcgacaaguuccugaacgugagcgaguggagcuacaucguggagaaggccggccccgccaacggccugugcuaccccggcgacuucaacgacuacgaggagcugaagcaccugcugagcagaaucaaccacuucgagaagaucgagaucauccccaagaaccacuggagcaaccacaacaccagcggcgugagcagcgccugcagcuaccuggagaaccccagcuucuucagaaacgugguguggcugaccaagaagaacaacaccuaccccaccaucaaggugaacuacaccaacgccaaccagaaggaccugcuggugcuguggggcauccaccaccccaacaacgaggccgagcagaagaugaucuaccagaacagcaacaccuacgugagcgugggcaccagcacccugaaccagagacuggugcccaagaucgccaccagaagcaaggugaacggccagagcggcagaaucgacuucuucuggaccauccugaagcccaacgacaccaucaacuucgacagcaacggcaacuucaucgcccccaaguacgccuacaagaucgugaagaagggcgacagcgccaucaugaagagcgagcugaaguacgacaacugcaacaccaagugccagacccccaucggcgccaucaacagcagcaugcccuuccacaacauccacccccugaccaucggcgagugccccaaguacgugaagagcaacagacuggugcuggccaccggccugagaaacgccccccagaucgagggcagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccguggacggcaucaccaacaagaucaacagcaucaucgacaagaugaacaaccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgagaaggugagacugcagcugagagacaacgccaaggagcugggcaacggcugcuucgaguucuaccacaagugcgacaacgagugcauggagagcgugaagaacggcaccuacgacuacccccaguacagcgaggaggccagacugaacagagaggagaucagcggcgugaagcuggagagcaccgugaccuaccagauccugagcaucuacagcaccguggccagcagccuggugcuggccaucaugguggccggccugagccuguggaugugcagcaacggcagccugcagugcagaaucugcaucuga

SEQ ID NO: 166514 - RNA, 1707 nt, Artificial Sequence
  derived and/or modified sequence opt4 from hemagglutinin__InfluenzaA__AAD37782
auggagagaaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugagagacugcagcguggccggcuggcugcugggcaaccccaugugcgacgaguucaucaacgugcccgaguggagcuacaucguggagaaggccagccccgccaacgaccugugcuaccccggcgacuucaacgacuacgaggagcugaagcaccugcugagcagaaccaaccacuucgagaagauccagaucaucccccccagcagcuggagcaaccacgacgccagcagcggcgugagcagcgccugccccuaccacggcagaagcagcuucuucagaaacgugguguggcugaucaagaagaacagcgccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccgagaucgccaccagacccaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacaccccccagagagagagaagaagaaagaagagaggccuguucggcgccaucgccggcuucaucgagggcggcuggcagggcauggugaacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagcagauggaggacggcuuccuggacguguggaccuacaacgccgagcugcuggugcugauggagaacgagagaacccuggacuuccacgacagcaacgugaagcaccuguacgacaaggugagacugcagcugagagacaacgccaaggagcugggcaacggcugcuucgaguucuaccacaagugcgacaacgagugcauggagagcgugaagaacggcaccuacgacuacccccaguacagcgaggaggccagacugaacagagaggagaucagcggcgugaagcuggagagcaugggcaccuaccagauccugagcaucuacagcaccguggccagcagccuggcccuggccaucaugguggccggccugagccuguggaugugcagcaacggcagccugcagugcagaaucugcaucuga

SEQ ID NO: 166515 - RNA, 1707 nt, Artificial Sequence
  derived and/or modified sequence opt4 from hemagglutinin__InfluenzaA__AAD51927
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugagagacugcagcguggccggcuggcugcugggcaaccccaugugcgacgaguucaucaacgugcccgaguggagcuacaucguggagaaggccagccccgccaacgaccugugcuaccccggcgacuucaacgacuacgaggagcugaagcaccugcugagcagaaccaaccacuucgagaagauccagaucauccccaagagcagcuggagcaaccacgacgccagcagcggcgugagcagcgccugccccuaccacggcagaagcagcuucuucagaaacgugguguggcugaucaagaagaacagcgccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccgagaucgccaccagacccaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacaccccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagcagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugaagaacggcaccuacgacuacccccaguacagcgaggaggccagacugaacagagaggagaucagcggcgugaagcuggagagcaugggcaccuaccagauccugagcaucuacagcaccguggccagcagccuggcccuggccaucaugguggccggccugagccuguggaugugcagcaacggcagccugcagugcagaaucugcaucuga

SEQ ID NO: 166516 - RNA, 1704 nt, Artificial Sequence; identical to SEQ ID NO: 160237
  derived and/or modified sequence opt4 from hemagglutinin__InfluenzaA__AEO89181

SEQ ID NO: 166517 - RNA, 1707 nt, Artificial Sequence; identical to SEQ ID NO: 161691
  derived and/or modified sequence opt4 from hemagglutinin__InfluenzaA__AFM78567

SEQ ID NO: 166518 - RNA, 1707 nt, Artificial Sequence
  derived and/or modified sequence opt4 from hemagglutinin__InfluenzaA__ACR48872
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccaugcuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugauggccggccugagccuguggaugugcagcaacggcagccugcagugcagaaucugcaucuga

SEQ ID NO: 166519 - RNA, 1707 nt, Artificial Sequence; identical to SEQ ID NO: 161691
  derived and/or modified sequence opt4 from hemagglutinin__InfluenzaA__ABW06108

SEQ ID NO: 166520 - RNA, 1707 nt, Artificial Sequence
  derived and/or modified sequence opt4 from hemagglutinin__InfluenzaA__EPI341633
auggagaagaucacccugcugcugagcaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugaaggacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagaccuacaacaacaccaaccaggaggaccugcugauccuguggggcauccaccaccccaacaacggcgccgagcagaccaugcuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccaccccaucaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucagcaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcaucuga

SEQ ID NO: 166521 - RNA, 1707 nt, Artificial Sequence
  derived and/or modified sequence opt4 from hemagglutinin__InfluenzaA__ABD95991
auggagaagaucaugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 166522 - RNA, 1707 nt, Artificial Sequence
  derived and/or modified sequence opt4 from hemagglutinin__InfluenzaA__AGN69453
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcgccggcgugagcagcgccugccccuaccagggcaugagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccaagcuguaccagaacagcaccaccuacaucagcgugggcaccagcacccugaaccagagacuggugcccaagaucgccaccagaagcaaggugaacggccagagcggcagaaucgaguucuucuggaccauccugaagcccaacgacaccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcagcagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 166523 - RNA, 1707 nt, Artificial Sequence
  derived and/or modified sequence opt4 from hemagglutinin__InfluenzaA__AGN69452
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcgccggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccagaacagcaccaccuacaucagcgugggcaccagcacccugaaccagagacuggugcccaagaucgccaccagaagcaaggugaacggccagagcggcagaaucgaguucuucuggaccauccugaagcccaacgacaccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcagcagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 166524 - RNA, 1707 nt, Artificial Sequence
  derived and/or modified sequence opt4 from hemagglutinin__InfluenzaA__ABD73284
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcgccggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcagcagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 166525 - RNA, 1695 nt, Artificial Sequence
  derived and/or modified sequence opt4 from hemagglutinin__InfluenzaA__ABF93440
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagaucgagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 166526 - RNA, 1701 nt, Artificial Sequence
  derived and/or modified sequence opt4 from hemagglutinin__InfluenzaA__AKC45369
auggagaagaucgugcugcugcuggccguggugagccuggugaagagcgaccagaucugcaucggcuaccacgccaacaacagcaccgagcagguggacaccaucauggagaagaacgugaccgugacccacgcccaggacauccuggagaagacccacaacggcagacugugcgaccugaacggcgugaagccccugauccugaaggacugcagcguggccggcuggcugcugggcaaccccaugugcgacgaguucaucagagugcccgaguggagcuacaucguggagagagccaaccccgccaacgaccugugcuaccccggcaaccugaacgacuacgaggagcugaagcaccugcugagcagaaucaaccacuucgagaagacccugaucauccccaagagcagcuggcccaaccacaccagcagcggcgugagcgccgccugccccuaccagggcacccccagcuucuucagaaacgugguguggcugaccaagaagaacgacgccuaccccaccaucaagaugagcuacaacaacaccaacagagaggaccugcugauccuguggggcauccaccacagcaacaacgccgccgagcagaccaaccuguacaagaaccccaccaccuacgugagcgugggcaccagcacccugaaccagagacuggugcccaagaucgccaccagaagccaggugaacggccagagaggcagaauggacuucuucuggaccauccugaagcccaacgacgccauccacuucgagagcaacggcaacuucaucgcccccgaguacgccuacaagaucgugaagaagggcgacagcaccaucaugaagagcgagauggaguacggccacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacagagagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaucguggccggccugagccuguggaugugcagcaacggcagccugcagugcagaaucugcaucuga

SEQ ID NO: 166527 - RNA, 1704 nt, Artificial Sequence; identical to SEQ ID NO: 165478
  derived and/or modified sequence opt4 from hemagglutinin__InfluenzaA__AJS18479

SEQ ID NO: 166528 - RNA, 1704 nt, Artificial Sequence
  derived and/or modified sequence opt4 from hemagglutinin__InfluenzaA__EPI691378
auggagaagaucgugcugcugcuggccguggugagccuggugaagagcgaccagaucugcaucggcuaccacgccaacaacagcaccgagcagguggacaccaucauggagaagaacgugaccgugacccacgcccaggacauccuggagaagacccacaacggcagacugugcgaccugaacggcgugaagccccugauccugaaggacugcagcguggccggcuggcugcugggcaaccccaugugcgacgaguucaucagagugcccgaguggagcuacaucguggagagagccaaccccgccaacgaccugugcuaccccggcaaccugaacgacuacgaggagcugaagcaccugcugagcagaaucaaccacuucgagaagacccugaucauccccaagagcagcuggcccaaccacgagaccagccugggcgugagcgccgccugccccuaccagggcgugcccagcuucuucagaaacgugguguggcugaccaagaagaacgacgccuaccccaccaucaagaugagcuacaacaacaccaacagagaggaccugcugauccuguggggcauccaccacagcaacaacgccgccgagcagaccaaccuguacaagaaccccaccaccuacgugagcgugggcaccagcacccugaaccagagacuggugcccaagaucgccaccagaagccaggugaacggccagagaggcagaauggacuucuucuggaccauccugaagcccaacgacgccauccacuucgagagcaacggcaacuucaucgcccccgaguacgccuacaagaucgugaagaagggcgacagcaccaucaugaagagcgagauggaguacggccacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacagagagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaucguggccggccugagccuguggaugugcagcaacggcagccugcagugcagaaucugcaucuga

SEQ ID NO: 166529 - RNA, 1704 nt, Artificial Sequence
  derived and/or modified sequence opt4 from hemagglutinin__InfluenzaA__EPI533583
auggagaagaucgugcugcugcuggccaucgugagccuggugaagggcgaccagaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaaccccaugugcgacgaguucaucagagugcccgaguggagcuacaucguggagagagccaaccccgccaacgaccugugcuaccccggcaaccugaacgacuacgaggagcugaagcaccugcugagcagaaucaaccacuucgagaagauccugaucauccccaagagcagcuggaccaaccacgagaccagccugggcgugagcgccgccugccccuaccagggcacccccagcuucuucagaaacgugguguggcugaucaagaagaacgacgccuaccccaccaucaagaucagcuacaacaacaccaaccaggaggaccugcugauccuguggggcgugcaccacagcaacaacgccgccgagcagaccaaccuguacaagaaccccaccaccuacaucagcgugggcaccagcacccugaaccagagacuggugcccaagaucgccaccagaagccaggugaacggccagagaggcagaauggacuucuucuggaccauccugaagcccaacgacgccauccacuucgagagcaacggcaacuucaucgcccccgaguacgccuacaagaucgugaagaagggcgacagcaccaucaugaagagcgagauggaguacggccacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagaagagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacaagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaucguggccggccugagccuguggaugugcagcaacggcagccugcagugcagaaucugcaucuga

SEQ ID NO: 166530 - RNA, 1701 nt, Artificial Sequence; identical to SEQ ID NO: 165491
  derived and/or modified sequence opt4 from hemagglutinin__InfluenzaA__AKS48023

SEQ ID NO: 166531 - RNA, 1701 nt, Artificial Sequence
  derived and/or modified sequence opt4 from hemagglutinin__InfluenzaA__EPI587621
auggagaagauggugcugcugcuggccgccgugagccuggugaagagcgaccagaucugcaucggcuaccacgccaacaacagcaccgagcagguggacaccaucauggagaagaacgugaccgugacccacgcccaggacauccuggagaagacccacaacggcagacugugcgaccugaacggcgugaagccccugauccugaaggacugcagcguggccggcuggcugcugggcaaccccaugugcgacgaguucaucagagugcccgaguggagcuacaucguggagagagccaaccccgccaacgaccugugcuaccccggcaaccugaacgacuacgaggagcugaagcaccugcugagcagaaucaaccacuucgagaagacccugaucauccccaagagcagcuggcccaaccacaccagcagcggcgugagcgccgccugccccuaccagggcaugcccagcuucuucagaaacgugguguggcugaccaagaagaacgacgccuaccccaccaucaagaugagcuacaacaacaccuacagagaggaccugcugauccuguggggcauccaccacagcaacaacgccgccgagcagaccaaccuguacaagaaccccaccaccuacgugagcgugggcaccagcacccugaaccagagacuggagcccaagaucgccaccagaagccaggugaacggccagagaggcagaauggacuucuucuggaccauccugaagcccaacgacgccauccacuucgagagcaacggcaacuucaucgcccccgaguacgccuacaagaucgugaagaagggcgacagcaccaucaugaagagcgagauggaguacggccacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacagagagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaucguggccggccugagccuguggaugugcagcaacggcagccugcagugcagaaucugcaucuga

SEQ ID NO: 166532 - RNA, 1704 nt, Artificial Sequence
  derived and/or modified sequence opt4 from hemagglutinin__InfluenzaA__AJE30333
auggagaagaucgugcugcugcuggccgugaucagccuggugaagagcgaccagaucugcaucggcuaccacgccaacaacagcaccaagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaaccccaugugcgacgaguucaucagagugcccgaguggagcuacaucguggagagagccaaccccgccaacgaccugugcuaccccggcacccugaacgacuacgaggagcugaagcaccugcugagcagaaucaaccacuucgagaagacccugaucauccccagaagcagcuggcccaaccacgagaccagccugggcgugagcgccgccugccccuaccagggcgccagcagcuucuucagaaacgugguguggcugaucaagaagaacgacgccuaccccaccaucaagaucagcuacaacaacaccaacagagaggaccugcugauccuguggggcauccaccacagcaacaacgccgccgagcagaccaaccuguacaagaaccccgacaccuacgugagcgugggcaccagcacccugaaccagagacuggugcccaagaucgccaccagaagccaggugaacggccagagcggcagaauggacuucuucuggaccauccugaagcccaacgacgccauccacuucgagagcaacggcaacuucaucgcccccgaguacgccuacaagaucgugaagaagggcgacagcaccaucaugaagagcgagauggaguacggccacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuaccccaaguacagcgaggaggccauccugaagagagaggagaucagcggcgugaagcuggagagcaucggcaccuaccagauccugagcaucuacagcaccguggccagcagccuggcccuggccaucaucguggccggccugagccuguggaugugcagcaacggcagccugcagugcagaaucugcaucuga

SEQ ID NO: 166533 - RNA, 1704 nt, Artificial Sequence
  derived and/or modified sequence opt4 from hemagglutinin__InfluenzaA__EPI459855
augaucgccaucguggugaucgccauccuggccagcgccggcaagagcgacaagaucugcaucggcuaccacgccaacaacagcaccacccagguggacacccugcuggagaagaacgugaccgugacccacagcguggagcugcuggagaaccagaaggagaagagauucugcaagaucaugaacaaggccccccuggaccugaaggacugcaccaucgagggcuggauccugggcaaccccaagugcgaccugcugcugggcgaccagagcuggagcuacaucguggagagacccaacgcccagaacggcaucugcuaccccggcgugcugaacgagcuggaggagcugaaggccuucaucggcagcggcgagagaguggagagauucgagauguuccccaagagcaccugggccggcguggacaccagcagaggcgugaccaacgccugccccagcuacaccaucgacagcagcuucuacagaaaccugguguggaucgugaagaccgacagcgccaccuaccccgugaucaagggcaccuacaacaacaccggcacccagcccauccuguacuucuggggcgugcaccacccccuggacaccaccgugcaggacaaccuguacggcagcggcgacaaguacgugagaaugggcaccgagagcaugaacuucgccaagagccccgagaucgccgccagacccgccgugaacggccagagaagcagaaucgacuacuacuggagcgugcugagacccggcgagacccugaacguggagagcaacggcaaccugaucgcccccugguacgccuacaaguucgugagcaccaacaagaagggcgccguguucaagagcgaccugcccaucgagaacugcgacgccaccugccagaccaucaccggcgugcugagaaccaacaagaccuuccagaacgugagcccccuguggaucggcgagugccccaaguacgugaagagcgagagccugagacuggccaccggccugagaaacgugccccagaucgccaccagaggcaucuucggcgccaucgccggcuucaucgagggcggcuggaccggcaugaucgacggcugguacggcuaccaccacgagaacagccagggcagcggcuacgccgccgacagagagagcacccagaaggccaucgacggcaucaccaacaaggugaacagcaucaucaacaagaugaacacccaguucgaggccguggaccacgaguucagcaaccuggagagaagaaucggcaaccugaacaagagaauggaggacggcuuccuggacguguggaccuacaacgccgagcugcuggugcugcuggagaacgagagaacccuggaccugcacgacgccaacgugaagaaccuguacgagaaggugaagagccagcugagagacaacgccaacgaccugggcaacggcugcuucgaguucuggcacaagugcgacaacgagugcauggagagcgugaagaacggcaccuacgacuaccccaaguaccagaaggagagcaagcugaacagacagggcaucgagagcgugaagcuggagaaccugggcguguaccagauccuggccaucuacagcaccgugagcagcagccuggugcuggugggccugaucauggccaucggccuguggaugugcagcaacggcagcaugcagugcagaaucugcaucuga

SEQ ID NO: 166534 - RNA, 1704 nt, Artificial Sequence; identical to SEQ ID NO: 166533
  derived and/or modified sequence opt4 from hemagglutinin__InfluenzaA__EPI459855/m1

SEQ ID NO: 166535 - RNA, 1692 nt, Artificial Sequence
  derived and/or modified sequence opt4 from hemagglutinin__InfluenzaA__ACZ36872
augaacacccagauccugguguucgcccugguggccgugauccacaccaacgccgacaagaucugccugggccaccacgccgugagcaacggcaccaaggugaacacccugaccgagagaggcguggagguggugaacgccaccgagaccguggagagaaccaacauccccaagaucugcagcaagggcaagagaaccguggaccugggccagugcggccugcugggcaccaucaccggccccccccagugcgaccaguuccuggaguucagcgccgaccugaucaucgagagaagagacggcaacgacgugugcuaccccggcaaguucgugaacggcgaggcccugagacagauccugagaaagagcggcggcaucaacaaggagaccaugggcuucaccuacagcggcaucagaaccaacggcaccaccagcgccugcagaagaagcggcagcagcuucuacgccgagaugaaguggcugcugagcgacaccgacaacgccgccuucccccagaugaccaagagcuacaagaacaccagaagagagcccgcccugaucguguggggcauccaccacagcggcagcaccaccgagcagaccaagcuguacggcagcggcaacaagcuggugaccgugggcagcagcaaguaccagcagagcuucgugcccagccccggcaccagaccccaggugaacggccagagcggcagaaucgacuuccacuggcugauccuggacagcaacgacaccgugaccuucagcuucaacggcgccuucaucgcccccgacagagccagcuuccugaagggcaagagcaugggcauccagagcgacgugcagguggacgccaacugcgagggcgagugcuaccacagcggcggcaccaucaccagcagccugcccuuccagaacaucaacagcagagccgugggcaagugccccagauacgugaagcaggagagccugcugcuggccaccggcaugaagaacgugcccgagcugcccaagaagagaagaaagagaggccuguucggcgccaucgccggcuucaucgagaacggcugggagggccugguggacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagaagcagaucggcaacgugaucaacuggaccagagacagcaucaccgagguguggagcuacaacgccgagcugcugguggccauggagaaccagcacaccaucgaccuggccgacagcgagaugaacaagcuguacgagagagugagaaagcagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcggcggcuacaaggacgugauccugugguucagcuucggcgccagcugcuuccugcugcuggccaucgccaugggccugguguucaucugcgugaagaacggcaacaugagaugcaccaucugcaucuga

SEQ ID NO: 166536 - RNA, 1692 nt, Artificial Sequence
  derived and/or modified sequence opt4 from hemagglutinin__InfluenzaA__AGB51388
augaacacccagauccugguguucgcccugguggccgugauccacaccaacgccgacaagaucugccugggccaccacgccgugagcaacggcaccaaggugaacacccugaccgagagaggcguggagguggugaacgccaccgagaccguggagagaaccaacauccccaagaucugcagcaagggcaagagaaccguggaccugggccagugcggccugcugggcaccaucaccggccccccccagugcgaccaguuccuggaguucagcgccgaccugaucaucgagagaagagacggcaacgacgugugcuaccccggcaaguucgugaacggcgaggcccugagacagauccugagaaagagcggcggcaucaacaaggagaccaugggcuucaccuacagcggcaucagaaccaacggcaccaccagcgccugcagaagaagcggcagcagcuucuacgccgagaugaaguggcugcugagcgacaccgacaacgccgccuucccccagaugaccaagagcuacaagaacaccagaagagagcccgcccugaucguguggggcauccaccacagcggcagcaccaccgagcagaccaagcuguacggcagcggcaacaagcuggugaccgugggcagcagcaaguaccagcagagcuucgugcccaaccccgagaccagaccccaggugaacggccagagcggcagaaucgacuuccacuggcugauccuggacagcaacgacaccgugaccuucagcuucaacggcgccuucaucgcccccgacagagccagcuuccugaagggcaagagcaugggcauccagagcgacgugcagguggacgccaacugcgagggcgagugcuaccacagcggcggcaccaucaccagcagccugcccuuccagaacaucaacagcagagccgugggcaagugccccagauacgugaagcaggagagccugcugcuggccaccggcaugaagaacgugcccgagcugcccaagaagagaagaaagagaggccuguucggcgccaucgccggcuucaucgagaacggcugggagggccugguggacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagaagcagaccggcaacgugaucaacuggaccagagacagcaucaccgagguguggagcuacaacgccgagcugcugguggccauggagaaccagcacaccaucgaccuggccgacagcgagaugaacaagcuguacgagagagugagaaagcagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcggcggcuacaaggacgugauccugugguucagcuucggcgccagcugcuuccugcugcuggccaucgccaugggccugguguucaucugcgugaagaacggcaacaugagaugcaccaucugcaucuga

SEQ ID NO: 166537 - RNA, 1683 nt, Artificial Sequence; identical to SEQ ID NO: 162508
  derived and/or modified sequence opt4 from hemagglutinin__InfluenzaA__EPI439507

SEQ ID NO: 166538 - RNA, 1704 nt, Artificial Sequence
  derived and/or modified sequence opt4 from hemagglutinin__InfluenzaA__EPI164216
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucgugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 166539 - RNA, 1683 nt, Artificial Sequence; identical to SEQ ID NO: 164871
  derived and/or modified sequence opt4 from hemagglutinin__InfluenzaA__EPI486492

SEQ ID NO: 166540 - RNA, 1683 nt, Artificial Sequence
  derived and/or modified sequence opt4 from hemagglutinin__InfluenzaA__EPI740738
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacagcggcaucagaaccaacggcgugaccagcgccugcaagagaagcggcagcagcuucuacgccgagaugaaguggcugcugagcaacaccgacaacgccgccuucccccagaugaccaagagcuacaagaacaccagaaagagccccgccaucaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugauccugaaccccaacgacaccgugaccuucagcuucaacggcgccuucaucgcccccgacagagccagcuuccugagaggcaagagcaugggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgccaagaccaaccagcaguucgagcugaucgacaacgaguucaacgagguggagaagcagaucggcaacgugaucaacuggaccagagacagcaucaccgagguguggagcuacaacgccgagcugcugaucgccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagaaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 166541 - RNA, 1683 nt, Artificial Sequence
  derived and/or modified sequence opt4 from hemagglutinin__InfluenzaA__EPI730495
augaacauccagauccugguguucgcccugaucgccaucauccccaccgacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagaaagagcggcggcaucgacaaggaggccaugggcuucaccuacagcggcaucagaaccaacggcgccaccagcgccugcagaagaagcggcagcagcuucuacgccgagaugaaguggcugcugagcaacaccgacaacgccgccuucccccagaugaccaagagcuacaagaacaccagaaagagccccgccaucaucguguggggcauccaccacagcgugagcaccgccgagcagaccaagcuguacggcagcggcagcaagcuggugaccgugggcagcagcaacuaccagcagagcuucgugcccagccccggcgccagaccccaggugaacggccugagcggcagaaucgacuuccacuggcugauccugaaccccaacgacaccgugaccuucagcuucaacggcgccuucaucgcccccgacagagccagcuuccugagaggcaagagcaugggcauccagagcggcgugcagguggacgccgacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaucgagguggagaagcagaucggcaacgugaucaacuggaccagagacagcaucaccgagguguggagcuacaacgccgagcugcugguggccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccaugcagaacagaauccagaucgaccccgugaagcugagcagcggcuacaaggacgugauccugugguucagcuucggcgccagcugcuucauccugcccgccaucgugaugggccugguguucaugugcgugaagaacggcaacaugagaugcaccaucugcaucuga

SEQ ID NO: 166542 - RNA, 1683 nt, Artificial Sequence
  derived and/or modified sequence opt4 from hemagglutinin__InfluenzaA__EPI712926
augaacacccagauccugguguucgcccugaucgccaucauccccaccaacgccgacaagaucugccugggccaccacgccgugagcaacggcaccaaggugaacacccugaccgagagaggcguggagguggugaacgccaccgagaccguggagagaaccaacauccccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacaacggcaucagaaucaacggcgugaccagcgccugcaagagaagcggcagcagcuucuacgccgagaugaaguggcugcugagcaacaccgacaacgccgccuucccccagaugaccaagagcuacaagaacaccagaaagagccccgccaucaucguguggggcauccaccacagcgugagcaccgccgagcagaccaagcuguacggcagcggcaacaagcuggugaccgugggcagcagcaacuaccagcagagcuucgugcccagccccggcgccagaccccaggugaacggccugagcggcagaaucgacuuccacuggcugauccugaaccccaacgacaccgugaccuucagcuucaacggcgccuucaucgcccccgacagagccagcuuccugagaggcaagagcaucggcauccagagcggcgugcagguggacgccaacugcgagggcgacugcuaccacagcggcggcaccaucaucagcaaccugcccuuccagaacaucgacagcagagccgugggcaagugccccagauacgugaagcagagaagccugcugcuggccaccggcaugaagaacgugcccgagauccccaagggcagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgccaagaccaaccagcaguucgagcugaucgacaacgaguucaacgagguggagaagcagaucggcaacgugaucaacuggaccagagacagcaucaccgagguguggagcuacaacgccgagcugcugaucgccauggagaaccagcacaccaucgaccuggccgacagcgagauggacaagcuguacgagagagugaagagacagcugagagagaacgccgaggaggacggcaccggcugcuucgagaucuuccacaagugcgacgacgacugcauggccagcaucagaaacaacaccuacgaccacagaaaguacagagaggaggccaugcagaacagaauccagaucgaccccgugaagcugagcagcggcuacaaggacgugauccugugguucagcuucggcgccagcugcuucauccugcuggccaucgugaugggccugguguucaucugcgugaagaacggcaacaugagaugcaccaucugcaucuga

SEQ ID NO: 166543 - RNA, 1683 nt, Artificial Sequence; identical to SEQ ID NO: 162508
  derived and/or modified sequence opt4 from hemagglutinin__InfluenzaA__AGL44438

SEQ ID NO: 166544 - RNA, 1683 nt, Artificial Sequence
  derived and/or modified sequence opt4 from hemagglutinin__InfluenzaA__EPI445996
auggagaccgugagccugaugaccauccugcugcuggugaccaccagcaacgccgacaagaucugcaucggccaccagagcaccaacagcaccgagaccguggacacccugaccgagaccaacgugcccgugacccacgccaaggagcugcugcacaccgaccacaacggcaugcugugcgccaccaaccugggccacccccugauccuggacaccugcaacguggagggccugaucuacggcaaccccagcugcgaccugcugcugggcggcagagaguggagcuacaucguggagagacccagcgccgugaacggcaccugcuaccccggcaacguggagaaccuggaggagcugagaacccuguucagcagcagcagcagcuaccagagaauccagaucuuccccgacaccaucuggaacgugaccuacaccggcaccagcaagagcugcagcgacagcuucuacagaaacaugagauggcugacccagaagaacggccuguaccccgugcaggacgcccaguucaccaacaacagaggcaaggacauccuguucguguggggcauccaccacccccccaccgacaccgcccagaccaaccuguacaccagaaccgacaccaccaccagcgugaccaccgagaaccuggacagaaccuucaagccccugaucggccccagaccccuggugaacggccugaucggcagaaucaacuacuacuggagcgugcugaagcccggccagacccugagagugagaagcaacggcaaccugaucgcccccugguacggccacgugcugagcggcgagagccacggcagaauccugaagaccaaccugaacagcggcaacugcguggugcagugccagaccgagaagggcggccugaacagcacccugcccuuccacaacaucagcaaguacgccuucggcaacugccccaaguacaucggcgugaagagccugaagcuggccaucggccugagaaacgugcccgccaagagcagcagaggccuguucggcgccaucgccggcuucaucgagggcggcuggcccggccugguggccggcugguacggcuuccagcacagcaacgaccagggcgugggcaucgccgccgacagagugagcacccagaaggccguggacaagaucaccagcaaggugaacaacaucguggacaagaugaacaagcaguacgagaucaucgaccacgaguucagcgagguggagaccagacugaacaugaucaacaacaagaucgacgaccagauccaggacgugugggccuacaacgccgagcugcuggugcugcuggagaaccagaagacccuggacgagcacgacgccaacgugaacaaccuguacaacaaggugaagagagcccugggcagcaacgcccuggaggacggcaagggcugcuucgagcuguaccacaagugcgacgaccagugcauggagaccaucagaaacggcaccuacaacagaagaaaguaccaggaggagagcagacuggagagacagaagaucgagggcaucaagcuggagagcgagggcaccuacaagauccugaccaucuacagcaccguggccagcagccuggugcuggccaugggcuucgccgccuuccuguucugggccaugagcaacggcagcugcagaugcaacaucugcaucuga

SEQ ID NO: 166545 - RNA, 1695 nt, Artificial Sequence
  derived and/or modified sequence opt4 from hemagglutinin__InfluenzaA__EPI433309
auggagaagaucgugcugcugcuggccaucgccagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacaaguucaacgacgugcccgaguggagcuacaucguggagaaggccaaccccgccaacgaccugugcuaccccggcaaccugaacgacuacgaggagcugaagcaccugcugagcagaaucaaccacuucgagaagauccagaccuuccccaagagcagcuggagcgaccacgaggccagccugggcgugagcgccgccugccccuaccagggcaugcccagcuucuucagaaacgugguguggcugaucaagaagaacaacaccuaccccaccaucaagagcagcuacaacaacaccaaccaggaggaccugcugauccuguggggcauccaccacagcaacgacgaggccgagcagaccagacuguaccagaacagcaacaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgaggugggcuacggcgacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccagaucgagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccguggagagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 166546 - RNA, 1683 nt, Artificial Sequence
  derived and/or modified sequence opt4 from hemagglutinin__InfluenzaA__EPI470859
auggaggccaucccccugaucaccauccugcugguggugaccgccagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccaaccugggcagaccccugauccuggacaccugcaccaucgagggccugaucuacggcaaccccagcugcgaccugcugcugggcggcagagaguggagcuacaucguggagagacccagcgccgugaacggcaugugcuaccccggcaacguggagaaccuggaggagcugagaagcuucuucagcagcgccagcagcuaccagagaauccagaucuuccccgacaccaucuggaacgugagcuacagcggcaccagcaaggccugcagcgacagcuucuacagaagcaugagauggcugacccagaagaacaacgccuaccccauccaggacgcccaguacaccaacaacagaggcaagagcauccuguucauguggggcaucaaccacccccccaccgacaccgcccagaccaaccuguacaccagaaccgacaccaccaccagcguggccaccgaggacaucaacagaaccuucaagcccgugaucggccccagaccccuggugaacggccugcagggcagaaucgacuacuacuggagcgugcugaagcccggccagacccugagagugagaagcaacggcaaccugaucgcccccugguacggccacauccugagcggcgagagccacggcagaauccugaagaccgaccugaacagcggcagcugcguggugcagugccagaccgagagaggcggccugaacaccacccugcccuuccacaacgugagcaaguacgccuucggcaacugccccaaguacgugggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcgugggcaucgccgccgacagagacagcacccagagagccaucgacaagaucaccagcaaggugaacaacaucguggacaagaugaacaagcaguacgagaucaucgaccacgaguucagcgagguggagaacagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccauggaggacggcaagggcugcuucgagcuguaccacaagugcgacgaccagugcauggagaccaucagaaacggcaccuacaacagaagaaaguacaaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 166547 - RNA, 1683 nt, Artificial Sequence
  derived and/or modified sequence opt4 from hemagglutinin__InfluenzaA__EPI498037
auggagaccgugagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugcugcuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacaacggcaccagcaaggccugcagcggcagcuucuacagaagcaugagauggcugaccagaaagaacggcgacuaccccauccaggacgugcaguacaccaacaaccagggcaagaacauccuguucauguggggcaucaaccacccccccaccgacaccacccagagagaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacaaccagugcauggagaccaucagaaacggcaccuacaacaagagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 166548 - RNA, 1683 nt, Artificial Sequence
  derived and/or modified sequence opt4 from hemagglutinin__InfluenzaA__AGO17847
auggagaccaucagccugaugaccauccugcugaucaccaccgccagcaacgccgacaagaucugcaucggccaccagagcaccaacagcaccgagaccguggacacccugaccgagaccaacgugcccgugacccacgccaaggagcugcugcagaccgagcacaacggcaugcugugcgccaccaaccugggccacccccugauccuggacaccugcaccaucgagggccugaucuacggcaaccccagcugcgaccugcugcuggagggcagagaguggagcuacaucguggagagacccagcgccgugaacggcaccugcuaccccggcaacguggagaaccuggaggagcugagaacccuguucagcagcgccagcagcuaccagagaauccagaucuuccccgacaccaccuggaacgugaccuacaccggcaccagcagaagcugcagcggcagcuucuacagaagcaugagauggcugacccagaagagcggcuucuaccccgugcaggacgccaaguacaccaacaacagaggcaagaacauccuguucguguggggcauccaccacccccacaccuacaccgaccagaccacccuguacaucagaaacgacaccaccaccagcgugaccaccgaggagcugaacagaaucuucaagcccgugaucgugcccagacugcuggugaacggccagcagggcagaaucgacuacuacuggagcgugcugaagcccggccagacccugagagugagaagcaacggcaaccugaucgcccccugguacggccacgugcugagcggcggcagccacggcagaauccugaagaccgaccugaagagcggcaacugcguggugcagugccagaccgagaagggcggccugaacagcacccugcccuuccacaacaucagcaaguacgccuucggcaccugccccaaguacgugaaggugaacagccugaagcuggccaucggccugagaaacgugcccgccagaagcaacagaggccuguucggcgccaucgccggcuucaucgagggcggcuggcccggccugguggccggcugguacggcuuccagcacagcaacgaccagggcgugggcauggccgccgacagagacagcacccagaaggccguggacaagaucaccagcaaggugaacaacaucguggacaagaugaacaagcaguacgagaucaucgaccacgaguucagcgagguggagaccagacugaacaugaucaacaacaagaucgacgaccagauccaggacgugugggccuacaacgccgagcugcuggugcugcuggagaaccagaagacccuggacgagcacgacgccaacgugaacaaccuguacaacaaggugaagagagcccugggcagcaacgccauggaggacggcaagggcugcuucgagcuguaccacaagugcgacgaccagugcauggagaccaucagaaacggcaccuacgacagaagaaaguacagagaggagagcagacuggagagacagagaaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 166549 - RNA, 1683 nt, Artificial Sequence
  derived and/or modified sequence opt4 from hemagglutinin__InfluenzaA__ANZ03807
auggagaccgugagccugaucaccauccugcugguggccaccgugagcaacgccgacaagaucugcaucggcuaccagagcaccaacagcaccgagaccguggacacccugaccgagaacaacgugcccgugacccacgccaaggagcugcugcacaccgagcacaacggcaugcugugcgccaccagccugggccagccccugauccuggacaccugcaccaucgagggccugaucuacggcaaccccagcugcgaccugagccuggagggcagagaguggagcuacaucguggagagacccagcgccgugaacggccugugcuaccccggcaacguggagaaccuggaggagcugagaagccuguucagcagcgccagaagcuaccagagaauccagaucuuccccgacaccaucuggaacgugagcuacgacggcaccagcaccgccugcagcggcagcuucuacagaagcaugagauggcugaccagaaagaacggcgacuaccccacccaggacgcccaguacaccaacaaccagggcaagaacauccuguucauguggggcaucaaccacccccccaccgacgacacccagagaaaccuguacaccagaaccgacaccaccaccagcguggccaccgaggagaucaacagaaucuucaagccccugaucggccccagaccccuggugaacggccugaugggcagaaucgacuacuacuggagcgugcugaagcccggccagacccugagaaucaagagcgacggcaaccugaucgcccccugguacggccacauccugagcggcgagagccacggcagaauccugaagaccgaccugaagagaggcagcugcaccgugcagugccagaccgagaagggcggccugaacaccacccugcccuuccagaacgugagcaaguacgccuucggcaacugcagcaaguacaucggcaucaagagccugaagcuggccgugggccugagaaacgugcccagcagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcaacgaccagugcauggagaccaucagaaacggcaccuacaacagaagaaaguaccaggaggagagcaagcuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 166550 - RNA, 1683 nt, Artificial Sequence; identical to SEQ ID NO: 166549
  derived and/or modified sequence opt4 from hemagglutinin__InfluenzaA__EPI680526

SEQ ID NO: 166551 - RNA, 1683 nt, Artificial Sequence; identical to SEQ ID NO: 166205
  derived and/or modified sequence opt4 from hemagglutinin__InfluenzaA__ALT20080

SEQ ID NO: 166552 - RNA, 1410 nt, Artificial Sequence
  derived and/or modified sequence opt4 from neuraminidase__InfluenzaA__AAA43084
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcggcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucaacaaggagagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 166553 - RNA, 1362 nt, Artificial Sequence
  derived and/or modified sequence opt4 from neuraminidase__InfluenzaA__AAA43397
augaaccccaaccagaagaucaucaccaucggcagcaucugcaugguggugggcaucaucagccugauccugcagaucggcaacaucaucagcaucuggaucagccacagcauccagaccggcaaccagaaccacaccggcaucugcaaccagggcagcaucaccuacaaggugguggccggccaggacagcaccagcgugauccugaccggcaacagcagccugugccccaucagaggcugggccauccacagcaaggacaacggcaucagaaucggcagcaagggcgacguguucgugaucagagagcccuucaucagcugcagccaccuggagugcagaaccuucuuccugacccagggcgcccugcugaacgacaagcacagcagaggcaccuucaaggacagaagccccuacagagcccugaugagcugccccgugggcgaggcccccagccccuacaacagcagauucgagagcguggccuggagcgccagcgccugccacgacggcgugggcuggcugaccaucggcaucagcggccccgacgacggcgccguggccgugcugaaguacaacagaaucaucaccgagaccaucaagagcuggagaaagaacauccugagaacccaggagagcgagugcaccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuacaagaucggcuacaucugcagcggcguguucggcgacaaccccagacccaaggacggcaccggcagcugcggccccgugagcgccgacggcgccaacggcgugaagggcuucagcuacaaguacggcaacggcguguggaucggcagaaccaagagcgacagcagcagacacggcuucgagaugaucugggaccccaacggcuggaccgagaccgacagcagauucagcaugagacaggacgugguggccaucaccaacagaagcggcuacagcggcagcuucgugcagcaccccgagcugaccggccuggacugcaugagacccugcuucuggguggagcugaucagaggccugcccgaggaggacgccaucuggaccagcggcagcaucaucagcuucugcggcgugaacagcgacaccguggacuggagcuggcccgacggcgccgagcugcccuucaccaucgacaaguga

SEQ ID NO: 166554 - RNA, 1365 nt, Artificial Sequence
  derived and/or modified sequence opt4 from neuraminidase__InfluenzaA__AAA43412
augaaccccaaccagaagaucaucaccaucggcagcaucugccugguggugggccugaucagccugauccugcagaucggcaacaucaucagcaucuggaucagccacagcauccagaccggcagccagaaccacaccggcaucugcaaccagaacaucaucaccuacaagaacagcaccugggugaaggacaccaccagcgugauccugaccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacagacacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcgccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccaaggacggcaccggcagcugcggccccguguacguggacggcgccaacggcgugaagggcuucagcuacagauacggcaacggcguguggaucggcagaaccaagagccacagcagcagacacggcuucgagaugaucugggaccccaacggcuggaccgagaccgacagcaaguucagcgugagacaggacgugguggccaugaccgacuggagcggcuacagcggcagcuucgugcagcaccccgagcugaccggccuggacugcaucagacccugcuucuggguggagcugaucagaggcagacccaaggagaagaccaucuggaccagcgccagcagcaucagcuucugcggcgugaacagcgacaccguggacuggagcuggcccgacggcgccgagcugcccuucaccaucgacaaguga

SEQ ID NO: 166555 - RNA, 1410 nt, Artificial Sequence
  derived and/or modified sequence opt4 from neuraminidase__InfluenzaA__AAG01743
augaaccccaaccagaagaucaucacccugggcagcgugagccugaccaucgccaccaucugcuuccugaugcagaucgccauccuggugaccaccgugacccugcacuucaagcaguacgagugcgacuaccccgccaacaaccaggccaugcccugcgagcccaucaucaucgagagaaacaucaccgagaucguguaccugaccaacaccaccaucgagaaggaggugugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaccagcccccugagcggcagcgcccagcacguggaggagugcagcugcuaccccagauaccccggcgugagaugcaucugcagagacaacuggaagggcagcaacagacccgugguggacaucaacgugaaggacuacagcaucaacagcagcuacgugugcagcggccuggugggcgacacccccagaaacaacgacagaagcagcagcagcuacugccagaaccccaacaacgagaagggcacccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaacaucaugcccaucuga

SEQ ID NO: 166556 - RNA, 1410 nt, Artificial Sequence
  derived and/or modified sequence opt4 from neuraminidase__InfluenzaA__AAG01759
augaaccccaaccagaagaucaucaccaucggcagcgugagccugaccaucgccaccaugugcuuccugaugcagaucgccauccuggugaccaccgugacccugcacuucaagcaguacgagugcaacagcccccccaacaaccaggugauccugugcgagcccaccaucaucgagagaaacaucaccgagaucguguaccugaccaacaccaccaucgagaaggagaucugccccaagcuggccgaguacaagaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugcugggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcaacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166557 - RNA, 1410 nt, Artificial Sequence
  derived and/or modified sequence opt4 from neuraminidase__InfluenzaA__AAG01777
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugauccugugcgagcccaccaucaucgagagaaacaucaccgagaucguguaccugaccaacaccaccaucgagaaggagaucugccccaagcuggccgaguacaagaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugcugggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcaacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacccgugaucguggacagaggcgacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166558 - RNA, 1410 nt, Artificial Sequence
  derived and/or modified sequence opt4 from neuraminidase__InfluenzaA__AAG01786
augaaccccaaccagaagaucaucaccaucggcagcgugagccugaccaucgccaccaugugcuuccugaugcagaucgccauccuggugaccaccgugacccugcacuucaagcaguacgagugcaacagcccccccaacaaccaggugauccugugcgagcccaccaucaucgagagaaacaucaccgagaucguguaccugaccaacaccaccaucgagaaggagaucugccccaagcuggccgaguacaagaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugcugggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcaacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcgacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166559 - RNA, 1410 nt, Artificial Sequence
  derived and/or modified sequence opt4 from neuraminidase__InfluenzaA__AAK71688
augaaccccaaccagaagaucaucaccaucggcagcgugagccugaccaucgccaccaugugcuuccugaugcagaucgccauccuggugaccaccgugacccugcacuucaagcaguacgagugcaacagcccccccaacaaccaggugauccugugcgagcccaccaucaucgagagaaacaucaccgagaucguguaccugaccaacgccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugcugggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcaacugccugaaccccaacaacgaggagggcggccacggcgugaagggcugggccuucgacgacggcaacgacguguggaugggcagaaccaucagcgaggagcugagaagcggcuacgagaccuucaaggugaucgagggcuggagcaagcccaacagcaagcugcagaucaacagacaggugaucguggacagaggcgacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166560 - RNA, 1410 nt, Artificial Sequence
  derived and/or modified sequence opt4 from neuraminidase__InfluenzaA__AAN01169
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166561 - RNA, 1410 nt, Artificial Sequence; identical to SEQ ID NO: 166560
  derived and/or modified sequence opt4 from neuraminidase__InfluenzaA__AAN01170

SEQ ID NO: 166562 - RNA, 1410 nt, Artificial Sequence
  derived and/or modified sequence opt4 from neuraminidase__InfluenzaA__AAN01171
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166563 - RNA, 1410 nt, Artificial Sequence; identical to SEQ ID NO: 166560
  derived and/or modified sequence opt4 from neuraminidase__InfluenzaA__AAN01172

SEQ ID NO: 166564 - RNA, 1410 nt, Artificial Sequence
  derived and/or modified sequence opt4 from neuraminidase__InfluenzaA__AAN01173
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaugugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166565 - RNA, 1410 nt, Artificial Sequence; identical to SEQ ID NO: 166560
  derived and/or modified sequence opt4 from neuraminidase__InfluenzaA__AAN01174

SEQ ID NO: 166566 - RNA, 1410 nt, Artificial Sequence; identical to SEQ ID NO: 166560
  derived and/or modified sequence opt4 from neuraminidase__InfluenzaA__AAN01175

SEQ ID NO: 166567 - RNA, 1410 nt, Artificial Sequence; identical to SEQ ID NO: 166560
  derived and/or modified sequence opt4 from neuraminidase__InfluenzaA__AAN01176

SEQ ID NO: 166568 - RNA, 1410 nt, Artificial Sequence; identical to SEQ ID NO: 166560
  derived and/or modified sequence opt4 from neuraminidase__InfluenzaA__AAN01177

SEQ ID NO: 166569 - RNA, 1410 nt, Artificial Sequence; identical to SEQ ID NO: 166560
  derived and/or modified sequence opt4 from neuraminidase__InfluenzaA__AAN01178

SEQ ID NO: 166570 - RNA, 1410 nt, Artificial Sequence; identical to SEQ ID NO: 166560
  derived and/or modified sequence opt4 from neuraminidase__InfluenzaA__AAN01179

SEQ ID NO: 166571 - RNA, 1410 nt, Artificial Sequence; identical to SEQ ID NO: 166560
  derived and/or modified sequence opt4 from neuraminidase__InfluenzaA__AAN01180

SEQ ID NO: 166572 - RNA, 1410 nt, Artificial Sequence
  derived and/or modified sequence opt4 from neuraminidase__InfluenzaA__AAN01181
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucggcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166573 - RNA, 1410 nt, Artificial Sequence; identical to SEQ ID NO: 166560
  derived and/or modified sequence opt4 from neuraminidase__InfluenzaA__AAN01182

SEQ ID NO: 166574 - RNA, 1410 nt, Artificial Sequence; identical to SEQ ID NO: 166560
  derived and/or modified sequence opt4 from neuraminidase__InfluenzaA__AAN01183

SEQ ID NO: 166575 - RNA, 1410 nt, Artificial Sequence; identical to SEQ ID NO: 166560
  derived and/or modified sequence opt4 from neuraminidase__InfluenzaA__AAN01184

SEQ ID NO: 166576 - RNA, 1410 nt, Artificial Sequence; identical to SEQ ID NO: 166560
  derived and/or modified sequence opt4 from neuraminidase__InfluenzaA__AAN01185

SEQ ID NO: 166577 - RNA, 1410 nt, Artificial Sequence
  derived and/or modified sequence opt4 from neuraminidase__InfluenzaA__AAN01186
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagacugggcuacgagaccuucaaggugaucgagggcuggagcaagagcaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166578 - RNA, 1410 nt, Artificial Sequence
  derived and/or modified sequence opt4 from neuraminidase__InfluenzaA__AAN01187
augaaccccaaccagaagaucaucaccaucggcagcgugagccugaccaucgccaccaucugcuuccugaugcagaucgccauccuggugaccaccgugacccugcacuucaagcaguacgagugcgacagccugcccaacaaccaggugaugcugugcgagcccaccaucaucgagagaaacaucaccgagaucguguaccugaccaacaccaccaucgagaaggagaugugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagaugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166579 - RNA, 1410 nt, Artificial Sequence; identical to SEQ ID NO: 166560
  derived and/or modified sequence opt4 from neuraminidase__InfluenzaA__AAN01188

SEQ ID NO: 166580 - RNA, 1410 nt, Artificial Sequence
  derived and/or modified sequence opt4 from neuraminidase__InfluenzaA__AAN64883
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcgacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166581 - RNA, 1410 nt, Artificial Sequence
  derived and/or modified sequence opt4 from neuraminidase__InfluenzaA__AAN64884
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166582 - RNA, 1410 nt, Artificial Sequence; identical to SEQ ID NO: 166581
  derived and/or modified sequence opt4 from neuraminidase__InfluenzaA__AAN64885

SEQ ID NO: 166583 - RNA, 1410 nt, Artificial Sequence; identical to SEQ ID NO: 166581
  derived and/or modified sequence opt4 from neuraminidase__InfluenzaA__AAN64886

SEQ ID NO: 166584 - RNA, 1410 nt, Artificial Sequence; identical to SEQ ID NO: 166581
  derived and/or modified sequence opt4 from neuraminidase__InfluenzaA__AAN64887

SEQ ID NO: 166585 - RNA, 1410 nt, Artificial Sequence
  derived and/or modified sequence opt4 from neuraminidase__InfluenzaA__AAN64888
augaaccccaaccagaagaucaucaccaucggcagcgugagccugaccaucgccaccaucugcuuccugaugcagaucgugauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 166586 - RNA, 1410 nt, Artificial Sequence; identical to SEQ ID NO: 166581
  derived and/or modified sequence opt4 from neuraminidase__InfluenzaA__AAN64889

SEQ ID NO: 166587 - RNA, 1410 nt, Artificial Sequence
  derived and/or modified sequence opt4 from neuraminidase__InfluenzaA__AAN64890
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggagaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166588 - RNA, 1410 nt, Artificial Sequence; identical to SEQ ID NO: 166581
  derived and/or modified sequence opt4 from neuraminidase__InfluenzaA__AAN64891

SEQ ID NO: 166589 - RNA, 1410 nt, Artificial Sequence
  derived and/or modified sequence opt4 from neuraminidase__InfluenzaA__AAO46212
augaaccccaaccagaagaucaucaccaucggcagcgugagccugaccaucgagaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgacaccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 166590 - RNA, 1410 nt, Artificial Sequence
  derived and/or modified sequence opt4 from neuraminidase__InfluenzaA__AAO46213
augaaccccaaccagaagaucaucaccaucgacagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgacaccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 166591 - RNA, 1410 nt, Artificial Sequence
  derived and/or modified sequence opt4 from neuraminidase__InfluenzaA__AAO46214
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggccguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaucugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 166592 - RNA, 1410 nt, Artificial Sequence
  derived and/or modified sequence opt4 from neuraminidase__InfluenzaA__AAO46215
augaaccccaaccagaagaucaucaccaucggcagcgugagccugaccaucgccaccgugugcuuccugaugcagaucgccauccuggccaccaccgugacccugcacuucaagcagcacgagugcgacagccccaccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacggcgacagcagcagcaacagcaacugcagagaccccaacaacgagagaggcaaccccggcgugaagggcugggccuucgacaacggcgacgacguguggaugggcagaaccaucagcaaggagagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 166593 - RNA, 1410 nt, Artificial Sequence
  derived and/or modified sequence opt4 from neuraminidase__InfluenzaA__AAO46216
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccagcaagugcuaccaguucgcccugggccagggcaccacccuggagaacaagcacagcaacggcaccaagcacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgagggcagacugguggacagcaucgugagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggacagcagaagcggcuacgagaccuucaaggugaucggcggcuggagcacccccaacagcaagagccaggugaacagacaggugaucguggacagcaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 166594 - RNA, 1410 nt, Artificial Sequence
  derived and/or modified sequence opt4 from neuraminidase__InfluenzaA__AAO46217
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccagcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacuggaggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugcuggacaucagcauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaagccaggagaccagagugugguggaccagcaacagcaucgugguguucugcggcaccagcggcaccuacggcaccggcagcuggcccgacggcgccaacaucaacuucaugcccaucuga

SEQ ID NO: 166595 - RNA, 1410 nt, Artificial Sequence
  derived and/or modified sequence opt4 from neuraminidase__InfluenzaA__AAO46218
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacuggaggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugcuggacaucagcauggaggacuacagcaucggcagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaagccaggagaccagagugugguggaccagcaacagcaucgugguguucugcggcaccagcggcaccuacggcaccggcagcuggcccgacggcgccaacaucaacuucaugcccaucuga

SEQ ID NO: 166596 - RNA, 1410 nt, Artificial Sequence
  derived and/or modified sequence opt4 from neuraminidase__InfluenzaA__AAO46220
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggccguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaucugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 166597 - RNA, 1410 nt, Artificial Sequence
  derived and/or modified sequence opt4 from neuraminidase__InfluenzaA__AAO46221
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggccgccgaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaucugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 166598 - RNA, 1410 nt, Artificial Sequence
  derived and/or modified sequence opt4 from neuraminidase__InfluenzaA__AAO46223
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcguggccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 166599 - RNA, 1410 nt, Artificial Sequence; identical to SEQ ID NO: 166598
  derived and/or modified sequence opt4 from neuraminidase__InfluenzaA__AAO46224

SEQ ID NO: 166600 - RNA, 1410 nt, Artificial Sequence
  derived and/or modified sequence opt4 from neuraminidase__InfluenzaA__AAO46225
augaaccccaaccagaagaucaucaccaucggcuucgugagccugaucaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccaagaucguguaccugaacaacaccaccaucgagaaggagaucugccccgaggugguggaguacagaaacuggagcaagccccagugccacaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcguggccuggagcagcagcagcugccacgacggcaaggccuggcugcacgugugcgugaccggcgacgacaagaacgccaccgccagcuucaucuacgacggcagacugguggacagcaucggcagcuggagccacaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacaacgacggcagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 166601 - RNA, 1410 nt, Artificial Sequence
  derived and/or modified sequence opt4 from neuraminidase__InfluenzaA__AAO46226
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcguggccuggagcagcagcagcugccacgacggcaaggccuggcugcacgugugcgugaccggcgacgacgagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 166602 - RNA, 1410 nt, Artificial Sequence
  derived and/or modified sequence opt4 from neuraminidase__InfluenzaA__AAO46229
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucauguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcguggccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccaucaucgacaucaacauggaggacuacagcaucgacagcagcuacgugugcagcggccuggugggcgacacccccagaaacgacgacagaagcagcaacagcaacugcagaaaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 166603 - RNA, 1410 nt, Artificial Sequence
  derived and/or modified sequence opt4 from neuraminidase__InfluenzaA__AAO46230
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaaccugaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcguggccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 166604 - RNA, 1410 nt, Artificial Sequence
  derived and/or modified sequence opt4 from neuraminidase__InfluenzaA__AAO46231
augaaccccaaccagaagaucaucaccaucggcagcgugagccugaccaucgccaccgugugcuuccugaugcagaucgccauccuggugaccaccgugacccugcacuucaagcagcacgacugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccgugaagugcuaccaguucgcccugggccagggcaccacccuggacaacaagcacagcaacgacaccgugcacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagaaaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 166605 - RNA, 1410 nt, Artificial Sequence
  derived and/or modified sequence opt4 from neuraminidase__InfluenzaA__AAO46232
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaccaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccaucaucgacaucaacauggaggacuacagcaucgacagcagcuacgugugcagcggccuggugggcgacacccccagaaacgacgacagaagcagcaacagcaacugcagaaaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 166606 - RNA, 1410 nt, Artificial Sequence
  derived and/or modified sequence opt4 from neuraminidase__InfluenzaA__AAO46233
augaaccccaaccagaagaucaucaccaucggcagcgugagccugaccaucgccgccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacagaagcggcuacagcggcaucuucagcguggagggcaagggcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 166607 - RNA, 1410 nt, Artificial Sequence
  derived and/or modified sequence opt4 from neuraminidase__InfluenzaA__AAO46235
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 166608 - RNA, 1410 nt, Artificial Sequence
  derived and/or modified sequence opt4 from neuraminidase__InfluenzaA__AAO46236
augaaccccaaccagaagaucaucaccaucggcagcgugagccugaccaucgccaccgugugcuuccugaugcacaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 166609 - RNA, 1410 nt, Artificial Sequence
  derived and/or modified sequence opt4 from neuraminidase__InfluenzaA__AAO46237
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaagaucguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 166610 - RNA, 1410 nt, Artificial Sequence
  derived and/or modified sequence opt4 from neuraminidase__InfluenzaA__AAO46238
augaaccccaaccagaagaucaucaccaucggcagcgccagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaagaucguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagaagggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaaccugaugcccaucuga

SEQ ID NO: 166611 - RNA, 1410 nt, Artificial Sequence
  derived and/or modified sequence opt4 from neuraminidase__InfluenzaA__AAO46241
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaagguggugggcuacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 166612 - RNA, 1410 nt, Artificial Sequence
  derived and/or modified sequence opt4 from neuraminidase__InfluenzaA__AAO46245
augaaccccaaccagaagaucaucaccaucggcagcgugagccugaccaucgccaccgugugcuuccugaugcagaucgccauccuggugaccaccgugacccugcacuucaagcagcacgacugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccgugaagugcuaccaguucgcccugggccagggcaccacccuggacaacaagcacagcaacgacaccgugcacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccuggccggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcacccagggcgugaagggcugggccuucgacaacggcaacgaccuguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 166613 - RNA, 1410 nt, Artificial Sequence
  derived and/or modified sequence opt4 from neuraminidase__InfluenzaA__AAO46246
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaucaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgccguguucugcggcaccagcggcaccuacggcaccggcagcuggcccgacggcgccaacaucaacuucaugcccaucuga

SEQ ID NO: 166614 - RNA, 1410 nt, Artificial Sequence
  derived and/or modified sequence opt4 from neuraminidase__InfluenzaA__AAO46247
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 166615 - RNA, 1410 nt, Artificial Sequence
  derived and/or modified sequence opt4 from neuraminidase__InfluenzaA__AAO46462
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 166616 - RNA, 1410 nt, Artificial Sequence; identical to SEQ ID NO: 166615
  derived and/or modified sequence opt4 from neuraminidase__InfluenzaA__AAO46463

SEQ ID NO: 166617 - RNA, 1410 nt, Artificial Sequence; identical to SEQ ID NO: 166615
  derived and/or modified sequence opt4 from neuraminidase__InfluenzaA__AAO46464

SEQ ID NO: 166618 - RNA, 1410 nt, Artificial Sequence; identical to SEQ ID NO: 166615
  derived and/or modified sequence opt4 from neuraminidase__InfluenzaA__AAO46465

SEQ ID NO: 166619 - RNA, 1410 nt, Artificial Sequence; identical to SEQ ID NO: 166615
  derived and/or modified sequence opt4 from neuraminidase__InfluenzaA__AAO46466

SEQ ID NO: 166620 - RNA, 1410 nt, Artificial Sequence
  derived and/or modified sequence opt4 from neuraminidase__InfluenzaA__AAO46467
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugaccggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 166621 - RNA, 1410 nt, Artificial Sequence
  derived and/or modified sequence opt4 from neuraminidase__InfluenzaA__AAO46468
augaaccccaaccagaagaucaucaccaucggcagcgugagccugaccaucgccaccgugugcuuccugaugcagaucgccauccuggugaccaccgugacccugcacuucaagcaguacgagugcgacuuccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 166622 - RNA, 1410 nt, Artificial Sequence; identical to SEQ ID NO: 166615
  derived and/or modified sequence opt4 from neuraminidase__InfluenzaA__AAO46469

SEQ ID NO: 166623 - RNA, 1410 nt, Artificial Sequence
  derived and/or modified sequence opt4 from neuraminidase__InfluenzaA__AAO46471
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 166624 - RNA, 1410 nt, Artificial Sequence
  derived and/or modified sequence opt4 from neuraminidase__InfluenzaA__AAO46472
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaccaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucagcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 166625 - RNA, 1410 nt, Artificial Sequence; identical to SEQ ID NO: 166615
  derived and/or modified sequence opt4 from neuraminidase__InfluenzaA__AAO46473

SEQ ID NO: 166626 - RNA, 1410 nt, Artificial Sequence; identical to SEQ ID NO: 166615
  derived and/or modified sequence opt4 from neuraminidase__InfluenzaA__AAO46474

SEQ ID NO: 166627 - RNA, 1410 nt, Artificial Sequence; identical to SEQ ID NO: 166615
  derived and/or modified sequence opt4 from neuraminidase__InfluenzaA__AAO46475

SEQ ID NO: 166628 - RNA, 1410 nt, Artificial Sequence
  derived and/or modified sequence opt4 from neuraminidase__InfluenzaA__AAO46476
augaaccccaaccagaagaucaucaccaucggcagcgugagccugaccaucgccaccgugugcuuccugaugcagaucgccauccuggugaccaccgugacccugcacuucagacaguacgagugcgacagccccgccaacaaccaggugaugcccugcgagcccaccaucaucgagagaaacaucaccgagaucguguaccugaacaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacguggaggacuacagcaucgacagcagcuacgugugcagcggccuggugggcgacacccccagaaacaacgacagaagcagcaacagcaacugcagaaaccccaacaacgagagaggcaaccacggcgugaagggcugggccuucgacgacggcaacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 166629 - RNA, 1410 nt, Artificial Sequence; identical to SEQ ID NO: 166615
  derived and/or modified sequence opt4 from neuraminidase__InfluenzaA__AAO46477

SEQ ID NO: 166630 - RNA, 1410 nt, Artificial Sequence
  derived and/or modified sequence opt4 from neuraminidase__InfluenzaA__AAO46478
augaaccccaaccagaagaucaucaccaucggcagcgugagccugaucaucgccaccgugugcuuccugaugcagaucgccauccuggugaccaccgugacccugcacuucaagcagcacgagugcgacagccccagcagcaaccaggugaugcccugcgagcccaucaucaucgagagaaacaucaccgagaucguguaccugaacaacaccaccaucgagaaggagaccugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcaacgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccaucguggacaucaacaugaaggacuacagcaucgacagcagcuacgugugcagcggccuggugggcgacacccccagaaacgacgacagaagcagcaagagcaacugcagaaaccccaacaacgagagaggcaaccacggcgugaagggcugggccuucgacaacggcaacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccaacaucaacuucaugcccaucuga

SEQ ID NO: 166631 - RNA, 1410 nt, Artificial Sequence
  derived and/or modified sequence opt4 from neuraminidase__InfluenzaA__AAO46479
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaacagagugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcggcaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 166632 - RNA, 1410 nt, Artificial Sequence
  derived and/or modified sequence opt4 from neuraminidase__InfluenzaA__AAO46481
augaaccccaaccagaagaucaucaccaucggcagcgugagccugaccaucgccaccgugugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagauacgugugcagcggccuggugggcgacacccccagaaacaacgacagaagcagcaacagcaacugcagaaaccccaacaacgagagaggcaaccacggcgugaagggcugggccuucgacgacggcaacgacguguggaugggcagaaccaucagcaaggacagcagaagcggcuacgagaccuucaaggugaucggcggcuggagcacccccaacagcaagagccagaucaacagacaggugaucguggacagcgacaacagaagcggcuacagcggcaucuucagcguggagagcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 166633 - RNA, 1410 nt, Artificial Sequence
  derived and/or modified sequence opt4 from neuraminidase__InfluenzaA__AAO46482
augaaccccaaccagaagaucaucaccaucggcagcgugagccugaccaucgccaccgugugcuuccugaugcagaucgccauccuggugaccaccgugacccugcacuucaagcaguacgagugcgacagccccgccaacaaccaggugaugcccugcgagcccaugaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagauacgugugcagcggccuggugggcgacacccccagaaacaacgacagaagcagcaacagcaacugcagaaaccccaacaacgacaagggcaaccacggcgugaagggcugggccuucgacgacggcaacgacguguggaugggcagaaccaucagcaaggacagcagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 166634 - RNA, 1410 nt, Artificial Sequence
  derived and/or modified sequence opt4 from neuraminidase__InfluenzaA__AAO46483
augaaccccaaccagaagaucaucaccaucggcagcgugagccugaccaucgccaccgugugcuuccugaugcagaucgccauccuggugaccaccgugacccugcacuucagacaguacgagugcgacagccccgccaacaaccaggugaugcccugcgagcccaucaucaucgagagaaacaucaccgagaucguguaccugaacaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacguggaggacuacagcaucgacagcagcuacgugugcagcggccuggugggcgacacccccagaaacaacgacagaagcagcaacagcaacugcagaaaccccaacaacgagagaggcaaccacggcgugaagggcugggccuucgacgacggcaacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 166635 - RNA, 1410 nt, Artificial Sequence
  derived and/or modified sequence opt4 from neuraminidase__InfluenzaA__AAO46485
augaaccccaaccagaagaucaucaccaucggcagcgugagccugaccaucgccaccgugugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagauacgugugcagcggccuggugggcgacacccccagaaacaacgacagaagcagcaacagcaacugcagaaaccccaacaacgacaagggcaaccacggcgugaagggcugggccuucgacgacggcaacgacguguggaugggcagaaccaucagcaaggacagcagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 166636 - RNA, 1410 nt, Artificial Sequence
  derived and/or modified sequence opt4 from neuraminidase__InfluenzaA__AAO46486
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagagaggcaaccacggcgugaagggcugggccuucgacgacggcaacgacguguggaugggcagaaccaucagcaaggacagcagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 166637 - RNA, 1410 nt, Artificial Sequence
  derived and/or modified sequence opt4 from neuraminidase__InfluenzaA__AAO46489
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcaaggccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcagcagcuacugcagaaaccccaacaacgagagaggcaaccacggcgugaagggcugggccuucgacgacggcaacgacguguggaugggcagaaccaucagcaaggacagcagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 166638 - RNA, 1410 nt, Artificial Sequence
  derived and/or modified sequence opt4 from neuraminidase__InfluenzaA__AAO46491
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 166639 - RNA, 1410 nt, Artificial Sequence; identical to SEQ ID NO: 166638
  derived and/or modified sequence opt4 from neuraminidase__InfluenzaA__AAO46492

SEQ ID NO: 166640 - RNA, 1410 nt, Artificial Sequence
  derived and/or modified sequence opt4 from neuraminidase__InfluenzaA__AAO88264
augaacaccaaccagagaaucaucaccaucggcaccgugugccugaucgugggcaucgugagccugcugcugcagaucggcaacaucgugagccuguggaucagccacagcauccagaccggcaagaagaacuacagcaagaucugcagcaagagcgugaucaccuacgagaacaacaccugggugaaccagaccuacgugaacaucagcaacaucaacaucgccgacggccagggcgugaacagcaucauccuggccggcaacagcagccugugccccaucagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagaucuucaagauggagaagggcaagaucaucaagagcguggagcuggacgcccccaacuaccacuacgaggagugcagcugcuaccccgacaccggcaagguggugugcgugugcagcgacaacuggcacgccagcaacagacccugggugagcuucgaccagaaccuggacuaccagaucggcuacaucugcagcggcguguucggcgacaaccccagaagcaacgacggcagaggcaacugcggccccgugcugagcaacggcgccaacggcgugaagggcuucagcuucagauacggcaacggcguguggaucggcagaaccaagagcaucagcagcagaagcggcuucgagaugaucugggaccccaacggcuggaccgagaccgacagcagcuucagcaucaagcaggacgugaucgcccugaccgacuggagcggcuacagcggcagcuucgugcagcaccccgagcugaccggcaugaacugcaucagacccugcuucuggguggagcugaucagaggccagcccaaggagagcaccaucuggaccagcggcagcagcaucagcuucugcggcguggacagcgagaccgccagcuggagcuggcccgacggcgccgaccugcccuucaccaucgacaaguga

SEQ ID NO: 166641 - RNA, 1410 nt, Artificial Sequence
  derived and/or modified sequence opt4 from neuraminidase__InfluenzaA__AAQ10334
augaaccccaaccagaagaucaucaccaucggcagcgugagccugaccaucgccaccaucugcuuccugaugcagaucgccauccuggugaccaccgugacccugcacuucaagcaguacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166642 - RNA, 1410 nt, Artificial Sequence; identical to SEQ ID NO: 166641
  derived and/or modified sequence opt4 from neuraminidase__InfluenzaA__AAQ10335

SEQ ID NO: 166643 - RNA, 1410 nt, Artificial Sequence
  derived and/or modified sequence opt4 from neuraminidase__InfluenzaA__AAQ10336
augaaccccaaccagaagaucaucaccaucggcagcgugagccugaccaucgccaccaucugcuuccugaugcagaucgccauccuggugaccaccgugacccugcacuucaagcaguacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgagaucaaccugaugcccaucuga

SEQ ID NO: 166644 - RNA, 1410 nt, Artificial Sequence; identical to SEQ ID NO: 166641
  derived and/or modified sequence opt4 from neuraminidase__InfluenzaA__AAQ10337

SEQ ID NO: 166645 - RNA, 1410 nt, Artificial Sequence
  derived and/or modified sequence opt4 from neuraminidase__InfluenzaA__AAQ10339
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagacccugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166646 - RNA, 1410 nt, Artificial Sequence
  derived and/or modified sequence opt4 from neuraminidase__InfluenzaA__AAQ10341
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166647 - RNA, 1410 nt, Artificial Sequence
  derived and/or modified sequence opt4 from neuraminidase__InfluenzaA__AAQ10343
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucguggccuucugcggcaccagcggcaccuacggcaccggcagcuggcccgacggcgccgacaucaaccugaugcccaucuga

SEQ ID NO: 166648 - RNA, 1191 nt, Artificial Sequence
  derived and/or modified sequence opt4 from neuraminidase__InfluenzaA__AAQ10344
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggccaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagcaagagcuga

SEQ ID NO: 166649 - RNA, 1416 nt, Artificial Sequence
  derived and/or modified sequence opt4 from neuraminidase__InfluenzaA__AAR11366
augaaccccaaccagaagcuguucgcccugagcggcguggccaucgcccugagcgugcugaaccugcugaucggcaucagcaacgugggccugaacgugagccugcaccugaaggagaagggccccaagcaggaggagaaccugaccugcaccaccaucaaccagaacaacaccaccgugguggagaacaccuacgugaacaacaccaccaucaucaccaagggcaccgaccugaagacccccagcuaccugcugcugaacaagagccugugcaacguggagggcuggguggugaucgccaaggacaacgccgugagauucggcgagagcgagcagaucaucgugaccagagagcccuacgugagcugcgaccccaccggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaugugcgugggcuggagcagcaccaccugccacgacggcaucgccagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggccuacaccaaggugauguacuuccacaagggccugguggugaaggaggaggagcugagaggcagcgccagacacaucgaggagugcagcugcuacggccacaaccagaaggugaccugcgugugcagagacaacuggcagggcgccaacagacccaucaucgagaucgacaugaacacccuggagcacaccagcagauacgugugcaccggcauccugaccgacaccagcagacccggcgacaagagcagcggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaccgaccccaacagcagaaucgccgagagacaggagaucguggacaacaacaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggccccggcagcuuccccgacggcgcccagauccaguacuucagcuga

SEQ ID NO: 166650 - RNA, 1350 nt, Artificial Sequence
  derived and/or modified sequence opt4 from neuraminidase__InfluenzaA__AAS89005
augaaccccaacaagaagaucaucaccaucggcagcaucugcauggugaccggcauggugagccugaugcugcagaucggcaaccugaucagcaucugggugagccacagcauccacaccggcaaccagcagaaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaucgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 166651 - RNA, 1350 nt, Artificial Sequence
  derived and/or modified sequence opt4 from neuraminidase__InfluenzaA__AAS89006
augaaccccaacaagaagaucaucaccaucggcagcaucugcauggugaccggcauggugagccugaugcugcagaucggcaaccugaucagcaucugggugagccacagcauccacaccggcaaccagcacaaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 166652 - RNA, 1410 nt, Artificial Sequence
  derived and/or modified sequence opt4 from neuraminidase__InfluenzaA__AAT38822
augaaccccaaccagaagaucaucaccaucggcguggugaacaccacccugagcaccaucgcccuguucaucggcgugggcaaccugguguucaacaccgugauccacgagaagaucggcgaccaccagaucgugacccaccccaccaucaugacccccgaggugcccaacugcagcgacaccaucaucaccuacaacaacaccgugaucaacaacaucaccaccaccaucaucaccgaggccgagagacccuucaagagcccccugccccugugccccuucagaggcuucuuccccuuccacaaggacaacgccaucagacugggcgagaacaaggacgugaucgugaccagagagcccuacgugagcugcgacaacgacaacugcuggagcuucgcccuggcccagggcgcccugcugggcaccaagcacagcaacggcaccaucaaggacagaacccccuacagaagccugaucagauuccccaucggcaccgcccccgugcugggcaacuacaaggagaucugcaucgccuggagcagcagcagcugcuucgacggcaaggaguggaugcacgugugcaugaccggcaacgacaacgacgccagcgcccagaucaucuacggcggcagaaugaccgacagcaucaagagcuggagaaaggacauccugagaacccaggagagcgagugccagugcaucgacggcaccugcgugguggccgugaccgacggccccgccgccaacagcgccgaccacagaguguacuggaucagagagggcagaaucaucaaguacgagaacgugcccaagaccaagauccagcaccuggaggagugcagcugcuacguggacaucgacguguacugcaucugcagagacaacuggaagggcagcaacagacccuggaugagaaucaacaacgagaccauccuggagaccggcuacgugugcagcaaguuccacagcgacacccccagacccgccgaccccagcaucaugagcugcgacagccccagcaacgugaacggcggccccggcgugaagggcuucggcuucaaggccggcaacgacguguggcugggcagaaccgugagcaccagcggcagaagcggcuucgagaucaucaaggugaccgagggcuggaucaacagccccaaccacgugaagagcaucacccagacccuggugagcaacaacgacuggagcggcuacagcggcagcuucaucgugaaggccaaggacugcuuccagcccugcuucuacguggagcugaucagaggcagacccaacaagaacgacgacgugagcuggaccagcaacagcaucgugaccuucugcggccuggacaacgagcccggcagcggcaacuggcccgacggcagcaacaucggcuucaugcccaaguga

SEQ ID NO: 166653 - RNA, 1350 nt, Artificial Sequence; identical to SEQ ID NO: 166651
  derived and/or modified sequence opt4 from neuraminidase__InfluenzaA__AAV65827

SEQ ID NO: 166654 - RNA, 1410 nt, Artificial Sequence
  derived and/or modified sequence opt4 from neuraminidase__InfluenzaA__AAX11488
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcgcccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166655 - RNA, 1410 nt, Artificial Sequence
  derived and/or modified sequence opt4 from neuraminidase__InfluenzaA__AAX11508
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacaacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166656 - RNA, 1410 nt, Artificial Sequence
  derived and/or modified sequence opt4 from neuraminidase__InfluenzaA__AAX11538
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgagagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166657 - RNA, 1410 nt, Artificial Sequence
  derived and/or modified sequence opt4 from neuraminidase__InfluenzaA__AAX11548
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166658 - RNA, 1410 nt, Artificial Sequence; identical to SEQ ID NO: 166655
  derived and/or modified sequence opt4 from neuraminidase__InfluenzaA__AAX11558

SEQ ID NO: 166659 - RNA, 1410 nt, Artificial Sequence
  derived and/or modified sequence opt4 from neuraminidase__InfluenzaA__AAX11568
augaaccccaaccagaagaucaucaccaucggcagcgugagccugaccaucgccaccaucugcuuccugaugcagaucgccauccuggugaccaccgugacccugcacuucaagcagcacgagugcuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166660 - RNA, 1410 nt, Artificial Sequence; identical to SEQ ID NO: 166655
  derived and/or modified sequence opt4 from neuraminidase__InfluenzaA__AAX11578

SEQ ID NO: 166661 - RNA, 1410 nt, Artificial Sequence
  derived and/or modified sequence opt4 from neuraminidase__InfluenzaA__AAX11588
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcaucugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggagaagaccgaggugugguggaccagcaacagcaucgugguguucugcggcaccagcggcaccuacggcaccggcagcuggcccgacggcgccgacaucaaccugaugcccaucuga

SEQ ID NO: 166662 - RNA, 1410 nt, Artificial Sequence; identical to SEQ ID NO: 166657
  derived and/or modified sequence opt4 from neuraminidase__InfluenzaA__AAX11598

SEQ ID NO: 166663 - RNA, 1410 nt, Artificial Sequence; identical to SEQ ID NO: 166657
  derived and/or modified sequence opt4 from neuraminidase__InfluenzaA__AAX11608

SEQ ID NO: 166664 - RNA, 1410 nt, Artificial Sequence
  derived and/or modified sequence opt4 from neuraminidase__InfluenzaA__AAX11618
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcgcccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166665 - RNA, 1410 nt, Artificial Sequence
  derived and/or modified sequence opt4 from neuraminidase__InfluenzaA__AAX12744
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166666 - RNA, 1410 nt, Artificial Sequence; identical to SEQ ID NO: 166657
  derived and/or modified sequence opt4 from neuraminidase__InfluenzaA__AAX12754

SEQ ID NO: 166667 - RNA, 1410 nt, Artificial Sequence
  derived and/or modified sequence opt4 from neuraminidase__InfluenzaA__AAX12774
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugaacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166668 - RNA, 1410 nt, Artificial Sequence
  derived and/or modified sequence opt4 from neuraminidase__InfluenzaA__AAX12804
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacaacuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166669 - RNA, 1410 nt, Artificial Sequence
  derived and/or modified sequence opt4 from neuraminidase__InfluenzaA__AAX12814
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugaacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166670 - RNA, 1410 nt, Artificial Sequence
  derived and/or modified sequence opt4 from neuraminidase__InfluenzaA__AAX34064
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagagagagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166671 - RNA, 1410 nt, Artificial Sequence
  derived and/or modified sequence opt4 from neuraminidase__InfluenzaA__AAX35824
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccuggccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166672 - RNA, 1410 nt, Artificial Sequence; identical to SEQ ID NO: 166655
  derived and/or modified sequence opt4 from neuraminidase__InfluenzaA__AAX35834

SEQ ID NO: 166673 - RNA, 1410 nt, Artificial Sequence
  derived and/or modified sequence opt4 from neuraminidase__InfluenzaA__AAX35844
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcaacagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcugguucaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166674 - RNA, 1410 nt, Artificial Sequence
  derived and/or modified sequence opt4 from neuraminidase__InfluenzaA__AAX35854
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166675 - RNA, 1410 nt, Artificial Sequence
  derived and/or modified sequence opt4 from neuraminidase__InfluenzaA__AAX35864
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcggcaaggccgacaccaagauccuguucaucgaggagggcaagaucgugaacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166676 - RNA, 1410 nt, Artificial Sequence
  derived and/or modified sequence opt4 from neuraminidase__InfluenzaA__AAX47538
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccgccaucaucgagagaaacaucaccgagaucguguaccugaccaacaccaccaucgaggaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugaacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166677 - RNA, 1410 nt, Artificial Sequence; identical to SEQ ID NO: 166655
  derived and/or modified sequence opt4 from neuraminidase__InfluenzaA__AAX56383

SEQ ID NO: 166678 - RNA, 1410 nt, Artificial Sequence
  derived and/or modified sequence opt4 from neuraminidase__InfluenzaA__AAX56393
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggcaagggcaccacccugaacaacggccacagcaacaacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166679 - RNA, 1410 nt, Artificial Sequence; identical to SEQ ID NO: 166655
  derived and/or modified sequence opt4 from neuraminidase__InfluenzaA__AAX56413

SEQ ID NO: 166680 - RNA, 1410 nt, Artificial Sequence; identical to SEQ ID NO: 166657
  derived and/or modified sequence opt4 from neuraminidase__InfluenzaA__AAX56423

SEQ ID NO: 166681 - RNA, 1410 nt, Artificial Sequence; identical to SEQ ID NO: 166655
  derived and/or modified sequence opt4 from neuraminidase__InfluenzaA__AAX56433

SEQ ID NO: 166682 - RNA, 1410 nt, Artificial Sequence; identical to SEQ ID NO: 166674
  derived and/or modified sequence opt4 from neuraminidase__InfluenzaA__AAX56443

SEQ ID NO: 166683 - RNA, 1410 nt, Artificial Sequence
  derived and/or modified sequence opt4 from neuraminidase__InfluenzaA__AAX56473
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagaacugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166684 - RNA, 1410 nt, Artificial Sequence
  derived and/or modified sequence opt4 from neuraminidase__InfluenzaA__AAX56483
augaaccccaaccagaagaucaucaccaucggcagcgugagccugaccaucgccaccaucugcuuccugaugcagaucgccauccuggugaccaccgugacccugcacuucaagcaguacgagugcgacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166685 - RNA, 1410 nt, Artificial Sequence; identical to SEQ ID NO: 166684
  derived and/or modified sequence opt4 from neuraminidase__InfluenzaA__AAX56503

SEQ ID NO: 166686 - RNA, 1410 nt, Artificial Sequence
  derived and/or modified sequence opt4 from neuraminidase__InfluenzaA__AAX56513
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166687 - RNA, 1413 nt, Artificial Sequence
  derived and/or modified sequence opt4 from neuraminidase__InfluenzaA__AAX56533
augaaccccaaccagaagaucaucaccaucggcagcaucagcguggccaucggcaucaucagccugauccugcagaucggcaacaucaucagcaucugggccagccacagcauccagaccggcagccagaacuacaccggcaucugcaaccagagaaucaucaccuacgagaacagaaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuucagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaacgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 166688 - RNA, 1410 nt, Artificial Sequence
  derived and/or modified sequence opt4 from neuraminidase__InfluenzaA__AAX56543
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccagcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgaggagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166689 - RNA, 1410 nt, Artificial Sequence; identical to SEQ ID NO: 166581
  derived and/or modified sequence opt4 from neuraminidase__InfluenzaA__AAX56553

SEQ ID NO: 166690 - RNA, 1410 nt, Artificial Sequence
  derived and/or modified sequence opt4 from neuraminidase__InfluenzaA__AAX56563
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcgcccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagagacaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166691 - RNA, 1410 nt, Artificial Sequence
  derived and/or modified sequence opt4 from neuraminidase__InfluenzaA__AAX56573
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166692 - RNA, 1410 nt, Artificial Sequence
  derived and/or modified sequence opt4 from neuraminidase__InfluenzaA__AAX56583
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagaccacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166693 - RNA, 1410 nt, Artificial Sequence
  derived and/or modified sequence opt4 from neuraminidase__InfluenzaA__AAX56593
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugaacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166694 - RNA, 1410 nt, Artificial Sequence
  derived and/or modified sequence opt4 from neuraminidase__InfluenzaA__AAX56603
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgcccacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166695 - RNA, 1410 nt, Artificial Sequence; identical to SEQ ID NO: 166665
  derived and/or modified sequence opt4 from neuraminidase__InfluenzaA__AAX57647

SEQ ID NO: 166696 - RNA, 1410 nt, Artificial Sequence; identical to SEQ ID NO: 166655
  derived and/or modified sequence opt4 from neuraminidase__InfluenzaA__AAX57657

SEQ ID NO: 166697 - RNA, 1410 nt, Artificial Sequence; identical to SEQ ID NO: 166693
  derived and/or modified sequence opt4 from neuraminidase__InfluenzaA__AAX57667

SEQ ID NO: 166698 - RNA, 1410 nt, Artificial Sequence; identical to SEQ ID NO: 166674
  derived and/or modified sequence opt4 from neuraminidase__InfluenzaA__AAX57677

SEQ ID NO: 166699 - RNA, 1410 nt, Artificial Sequence
  derived and/or modified sequence opt4 from neuraminidase__InfluenzaA__AAX57687
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugaacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166700 - RNA, 1410 nt, Artificial Sequence
  derived and/or modified sequence opt4 from neuraminidase__InfluenzaA__AAX57697
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166701 - RNA, 1410 nt, Artificial Sequence
  derived and/or modified sequence opt4 from neuraminidase__InfluenzaA__AAX57707
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagauucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166702 - RNA, 1410 nt, Artificial Sequence; identical to SEQ ID NO: 166674
  derived and/or modified sequence opt4 from neuraminidase__InfluenzaA__AAX57717

SEQ ID NO: 166703 - RNA, 1410 nt, Artificial Sequence; identical to SEQ ID NO: 166693
  derived and/or modified sequence opt4 from neuraminidase__InfluenzaA__AAX57726

SEQ ID NO: 166704 - RNA, 1410 nt, Artificial Sequence; identical to SEQ ID NO: 166693
  derived and/or modified sequence opt4 from neuraminidase__InfluenzaA__AAX57737

SEQ ID NO: 166705 - RNA, 1410 nt, Artificial Sequence; identical to SEQ ID NO: 166581
  derived and/or modified sequence opt4 from neuraminidase__InfluenzaA__AAX57747

SEQ ID NO: 166706 - RNA, 1410 nt, Artificial Sequence; identical to SEQ ID NO: 166581
  derived and/or modified sequence opt4 from neuraminidase__InfluenzaA__AAX57757

SEQ ID NO: 166707 - RNA, 1410 nt, Artificial Sequence
  derived and/or modified sequence opt4 from neuraminidase__InfluenzaA__AAX57767
augaaccccaaccagaagaucaucaccaucggcagcgugagccugaccaucgccaccaucugcuuccugaugcagaucgccauccuggugaccaccgugacccugcacuucaagcaguacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166708 - RNA, 1410 nt, Artificial Sequence
  derived and/or modified sequence opt4 from neuraminidase__InfluenzaA__AAX57777
augaaccccaaccagaagaucaucaccaucggcagcgugagccugaucaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166709 - RNA, 1410 nt, Artificial Sequence
  derived and/or modified sequence opt4 from neuraminidase__InfluenzaA__AAX57787
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccaacaccaagauccuguucaucgaggagggcaagaucgugaacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166710 - RNA, 1410 nt, Artificial Sequence; identical to SEQ ID NO: 166581
  derived and/or modified sequence opt4 from neuraminidase__InfluenzaA__AAX57797

SEQ ID NO: 166711 - RNA, 1410 nt, Artificial Sequence; identical to SEQ ID NO: 166581
  derived and/or modified sequence opt4 from neuraminidase__InfluenzaA__AAX57807

SEQ ID NO: 166712 - RNA, 1410 nt, Artificial Sequence
  derived and/or modified sequence opt4 from neuraminidase__InfluenzaA__AAX57817
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucagcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166713 - RNA, 1410 nt, Artificial Sequence; identical to SEQ ID NO: 166581
  derived and/or modified sequence opt4 from neuraminidase__InfluenzaA__AAX57837

SEQ ID NO: 166714 - RNA, 1410 nt, Artificial Sequence
  derived and/or modified sequence opt4 from neuraminidase__InfluenzaA__AAX57847
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166715 - RNA, 1410 nt, Artificial Sequence
  derived and/or modified sequence opt4 from neuraminidase__InfluenzaA__AAX57857
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaccaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166716 - RNA, 1410 nt, Artificial Sequence; identical to SEQ ID NO: 166581
  derived and/or modified sequence opt4 from neuraminidase__InfluenzaA__AAX57867

SEQ ID NO: 166717 - RNA, 1410 nt, Artificial Sequence
  derived and/or modified sequence opt4 from neuraminidase__InfluenzaA__AAX57877
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcacaucuga

SEQ ID NO: 166718 - RNA, 1410 nt, Artificial Sequence; identical to SEQ ID NO: 166581
  derived and/or modified sequence opt4 from neuraminidase__InfluenzaA__AAX57887

SEQ ID NO: 166719 - RNA, 1410 nt, Artificial Sequence
  derived and/or modified sequence opt4 from neuraminidase__InfluenzaA__AAX57897
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacagcggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166720 - RNA, 1410 nt, Artificial Sequence
  derived and/or modified sequence opt4 from neuraminidase__InfluenzaA__AAX57907
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaugaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166721 - RNA, 1410 nt, Artificial Sequence; identical to SEQ ID NO: 166581
  derived and/or modified sequence opt4 from neuraminidase__InfluenzaA__AAX57917

SEQ ID NO: 166722 - RNA, 1410 nt, Artificial Sequence; identical to SEQ ID NO: 166581
  derived and/or modified sequence opt4 from neuraminidase__InfluenzaA__AAX57927

SEQ ID NO: 166723 - RNA, 1410 nt, Artificial Sequence
  derived and/or modified sequence opt4 from neuraminidase__InfluenzaA__AAX57937
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaugguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugagaaucuga

SEQ ID NO: 166724 - RNA, 1410 nt, Artificial Sequence
  derived and/or modified sequence opt4 from neuraminidase__InfluenzaA__AAX57947
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcagaaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgccagcagcuacaugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166725 - RNA, 1410 nt, Artificial Sequence; identical to SEQ ID NO: 166665
  derived and/or modified sequence opt4 from neuraminidase__InfluenzaA__AAX76626

SEQ ID NO: 166726 - RNA, 1410 nt, Artificial Sequence
  derived and/or modified sequence opt4 from neuraminidase__InfluenzaA__AAX76646
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacaacaccgugcacgacagaacccccuacagaacccugcugaugaacgagcugggcgugcccuuccaccugggcaccagacaggugugcaucgccuggagcagcagcggcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166727 - RNA, 1410 nt, Artificial Sequence; identical to SEQ ID NO: 166655
  derived and/or modified sequence opt4 from neuraminidase__InfluenzaA__AAX76656

SEQ ID NO: 166728 - RNA, 1410 nt, Artificial Sequence; identical to SEQ ID NO: 166700
  derived and/or modified sequence opt4 from neuraminidase__InfluenzaA__AAX76666

SEQ ID NO: 166729 - RNA, 1410 nt, Artificial Sequence; identical to SEQ ID NO: 166581
  derived and/or modified sequence opt4 from neuraminidase__InfluenzaA__AAX76696

SEQ ID NO: 166730 - RNA, 1410 nt, Artificial Sequence
  derived and/or modified sequence opt4 from neuraminidase__InfluenzaA__AAX76736
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcugagcgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcagaagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166731 - RNA, 1410 nt, Artificial Sequence
  derived and/or modified sequence opt4 from neuraminidase__InfluenzaA__AAX76766
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgugggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166732 - RNA, 1410 nt, Artificial Sequence; identical to SEQ ID NO: 166657
  derived and/or modified sequence opt4 from neuraminidase__InfluenzaA__AAY18089

SEQ ID NO: 166733 - RNA, 1410 nt, Artificial Sequence
  derived and/or modified sequence opt4 from neuraminidase__InfluenzaA__AAY18099
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacaacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucguggaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166734 - RNA, 1410 nt, Artificial Sequence
  derived and/or modified sequence opt4 from neuraminidase__InfluenzaA__AAY18109
augaaccccaaccagaagaucaucaccaucggcagcgugagccugaccaucgccaccaucugcuuccugaugcagaucgccauccuggugaccacccugacccugcacuucaagcaguacgagugcaacagcccccccaacaaccaggugaugcugugcgagcccgccaucaucgagagaaacaucaccgagaucguguaccugaccaacaccaccaucgagaaggagaagugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugaacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166735 - RNA, 1410 nt, Artificial Sequence; identical to SEQ ID NO: 166693
  derived and/or modified sequence opt4 from neuraminidase__InfluenzaA__AAY18119

SEQ ID NO: 166736 - RNA, 1410 nt, Artificial Sequence
  derived and/or modified sequence opt4 from neuraminidase__InfluenzaA__AAY18129
augaaccccaaccagaagaucaucaccaucggcagcgugagccugaccaucgccaccaucugcuuccugaugcagaucaccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagagcaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166737 - RNA, 1410 nt, Artificial Sequence
  derived and/or modified sequence opt4 from neuraminidase__InfluenzaA__AAY18139
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagagagagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166738 - RNA, 1410 nt, Artificial Sequence
  derived and/or modified sequence opt4 from neuraminidase__InfluenzaA__AAY18149
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaccguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166739 - RNA, 1410 nt, Artificial Sequence
  derived and/or modified sequence opt4 from neuraminidase__InfluenzaA__AAY18159
augaaccccaaccagaagaucaucaccaucggcagcgugagccugaucaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagaacugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166740 - RNA, 1410 nt, Artificial Sequence; identical to SEQ ID NO: 166581
  derived and/or modified sequence opt4 from neuraminidase__InfluenzaA__AAY18179

SEQ ID NO: 166741 - RNA, 1410 nt, Artificial Sequence; identical to SEQ ID NO: 166581
  derived and/or modified sequence opt4 from neuraminidase__InfluenzaA__AAY18189

SEQ ID NO: 166742 - RNA, 1410 nt, Artificial Sequence
  derived and/or modified sequence opt4 from neuraminidase__InfluenzaA__AAY18199
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccagggcgugaagggcugggccuucgacgacggcaacgacguguggaugggcagaaccaucagcgagaagcugcacagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166743 - RNA, 1410 nt, Artificial Sequence; identical to SEQ ID NO: 166684
  derived and/or modified sequence opt4 from neuraminidase__InfluenzaA__AAY18588

SEQ ID NO: 166744 - RNA, 1410 nt, Artificial Sequence; identical to SEQ ID NO: 166665
  derived and/or modified sequence opt4 from neuraminidase__InfluenzaA__AAY18614

SEQ ID NO: 166745 - RNA, 1410 nt, Artificial Sequence
  derived and/or modified sequence opt4 from neuraminidase__InfluenzaA__AAY27846
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166746 - RNA, 1410 nt, Artificial Sequence
  derived and/or modified sequence opt4 from neuraminidase__InfluenzaA__AAY27856
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166747 - RNA, 1410 nt, Artificial Sequence; identical to SEQ ID NO: 166657
  derived and/or modified sequence opt4 from neuraminidase__InfluenzaA__AAY27866

SEQ ID NO: 166748 - RNA, 1410 nt, Artificial Sequence
  derived and/or modified sequence opt4 from neuraminidase__InfluenzaA__AAY27962
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacaacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166749 - RNA, 1410 nt, Artificial Sequence
  derived and/or modified sequence opt4 from neuraminidase__InfluenzaA__AAY27997
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacaacaccgugcacgacagaacccccuacagaacccugcugaugaacgagaugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166750 - RNA, 1410 nt, Artificial Sequence; identical to SEQ ID NO: 166655
  derived and/or modified sequence opt4 from neuraminidase__InfluenzaA__AAY28007

SEQ ID NO: 166751 - RNA, 1410 nt, Artificial Sequence; identical to SEQ ID NO: 166700
  derived and/or modified sequence opt4 from neuraminidase__InfluenzaA__AAY28017

SEQ ID NO: 166752 - RNA, 1410 nt, Artificial Sequence; identical to SEQ ID NO: 166655
  derived and/or modified sequence opt4 from neuraminidase__InfluenzaA__AAY28268

SEQ ID NO: 166753 - RNA, 1410 nt, Artificial Sequence
  derived and/or modified sequence opt4 from neuraminidase__InfluenzaA__AAY28278
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaagcccgagaccgaggugugguggaccagcaacagcaucgugguguucugcggcaccagcggcaccuacggcaccggcagcuggcccgacggcgccgacaucaaccugaugcccaucuga

SEQ ID NO: 166754 - RNA, 1410 nt, Artificial Sequence; identical to SEQ ID NO: 166669
  derived and/or modified sequence opt4 from neuraminidase__InfluenzaA__AAY28288

SEQ ID NO: 166755 - RNA, 1410 nt, Artificial Sequence
  derived and/or modified sequence opt4 from neuraminidase__InfluenzaA__AAY28298
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcagacccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166756 - RNA, 1410 nt, Artificial Sequence; identical to SEQ ID NO: 166686
  derived and/or modified sequence opt4 from neuraminidase__InfluenzaA__AAY28308

SEQ ID NO: 166757 - RNA, 1410 nt, Artificial Sequence
  derived and/or modified sequence opt4 from neuraminidase__InfluenzaA__AAY28318
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcgccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166758 - RNA, 1410 nt, Artificial Sequence
  derived and/or modified sequence opt4 from neuraminidase__InfluenzaA__AAY28338
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccgccaucaucgagagaaacaucaccgagaucguguaccugaccaacaccaccaucgagaaggagaucagacccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugaacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166759 - RNA, 1410 nt, Artificial Sequence; identical to SEQ ID NO: 166665
  derived and/or modified sequence opt4 from neuraminidase__InfluenzaA__AAY28348

SEQ ID NO: 166760 - RNA, 1410 nt, Artificial Sequence; identical to SEQ ID NO: 166581
  derived and/or modified sequence opt4 from neuraminidase__InfluenzaA__AAY28358

SEQ ID NO: 166761 - RNA, 1410 nt, Artificial Sequence; identical to SEQ ID NO: 166665
  derived and/or modified sequence opt4 from neuraminidase__InfluenzaA__AAY28388

SEQ ID NO: 166762 - RNA, 1410 nt, Artificial Sequence; identical to SEQ ID NO: 166670
  derived and/or modified sequence opt4 from neuraminidase__InfluenzaA__AAY28398

SEQ ID NO: 166763 - RNA, 1410 nt, Artificial Sequence; identical to SEQ ID NO: 166684
  derived and/or modified sequence opt4 from neuraminidase__InfluenzaA__AAY28408

SEQ ID NO: 166764 - RNA, 1410 nt, Artificial Sequence; identical to SEQ ID NO: 166657
  derived and/or modified sequence opt4 from neuraminidase__InfluenzaA__AAY28505

SEQ ID NO: 166765 - RNA, 1410 nt, Artificial Sequence
  derived and/or modified sequence opt4 from neuraminidase__InfluenzaA__AAY28524
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacuacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166766 - RNA, 1410 nt, Artificial Sequence; identical to SEQ ID NO: 166655
  derived and/or modified sequence opt4 from neuraminidase__InfluenzaA__AAY28534

SEQ ID NO: 166767 - RNA, 1410 nt, Artificial Sequence
  derived and/or modified sequence opt4 from neuraminidase__InfluenzaA__AAY28544
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166768 - RNA, 1410 nt, Artificial Sequence; identical to SEQ ID NO: 166581
  derived and/or modified sequence opt4 from neuraminidase__InfluenzaA__AAY28554

SEQ ID NO: 166769 - RNA, 1410 nt, Artificial Sequence
  derived and/or modified sequence opt4 from neuraminidase__InfluenzaA__AAY28564
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcagacccaacagcaagcugcagaucaacagacaggugaucguggagagaggcaacagaagcggcuacagcggcaucuucagcguggagagcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166770 - RNA, 1410 nt, Artificial Sequence; identical to SEQ ID NO: 166655
  derived and/or modified sequence opt4 from neuraminidase__InfluenzaA__AAY28574

SEQ ID NO: 166771 - RNA, 1410 nt, Artificial Sequence; identical to SEQ ID NO: 166669
  derived and/or modified sequence opt4 from neuraminidase__InfluenzaA__AAY28584

SEQ ID NO: 166772 - RNA, 1410 nt, Artificial Sequence; identical to SEQ ID NO: 166581
  derived and/or modified sequence opt4 from neuraminidase__InfluenzaA__AAY28594

SEQ ID NO: 166773 - RNA, 1410 nt, Artificial Sequence
  derived and/or modified sequence opt4 from neuraminidase__InfluenzaA__AAY28611
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166774 - RNA, 1410 nt, Artificial Sequence; identical to SEQ ID NO: 166686
  derived and/or modified sequence opt4 from neuraminidase__InfluenzaA__AAY28651

SEQ ID NO: 166775 - RNA, 1410 nt, Artificial Sequence
  derived and/or modified sequence opt4 from neuraminidase__InfluenzaA__AAY44613
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagaucgccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166776 - RNA, 1410 nt, Artificial Sequence; identical to SEQ ID NO: 166669
  derived and/or modified sequence opt4 from neuraminidase__InfluenzaA__AAY44624

SEQ ID NO: 166777 - RNA, 1410 nt, Artificial Sequence; identical to SEQ ID NO: 166691
  derived and/or modified sequence opt4 from neuraminidase__InfluenzaA__AAY44634

SEQ ID NO: 166778 - RNA, 1410 nt, Artificial Sequence; identical to SEQ ID NO: 166684
  derived and/or modified sequence opt4 from neuraminidase__InfluenzaA__AAY44644

SEQ ID NO: 166779 - RNA, 1410 nt, Artificial Sequence
  derived and/or modified sequence opt4 from neuraminidase__InfluenzaA__AAY44654
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagauccacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166780 - RNA, 1410 nt, Artificial Sequence
  derived and/or modified sequence opt4 from neuraminidase__InfluenzaA__AAY44758
augaaccccaaccagaagaucaucaccaucggcagcgugagccugaccaucgccaccaucugcuuccugaugcagaucgccauccuggugaccaccgugacccugcacuucaagcaguacgagugcaacagccccagcaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaagcccgagaccgaggugugguggaccagcaacagcaucgugguguucugcggcaccagcggcaccuacggcaccggcagcuggcccgacggcgccgacaucaaccugaugcccaucuga

SEQ ID NO: 166781 - RNA, 1410 nt, Artificial Sequence; identical to SEQ ID NO: 166581
  derived and/or modified sequence opt4 from neuraminidase__InfluenzaA__AAY44778

SEQ ID NO: 166782 - RNA, 1410 nt, Artificial Sequence
  derived and/or modified sequence opt4 from neuraminidase__InfluenzaA__AAY44788
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaucuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166783 - RNA, 1410 nt, Artificial Sequence; identical to SEQ ID NO: 166657
  derived and/or modified sequence opt4 from neuraminidase__InfluenzaA__AAY44909

SEQ ID NO: 166784 - RNA, 1410 nt, Artificial Sequence; identical to SEQ ID NO: 166684
  derived and/or modified sequence opt4 from neuraminidase__InfluenzaA__AAY45649

SEQ ID NO: 166785 - RNA, 1410 nt, Artificial Sequence
  derived and/or modified sequence opt4 from neuraminidase__InfluenzaA__AAY46374
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccuacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggagagaggcaacaugagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166786 - RNA, 1410 nt, Artificial Sequence
  derived and/or modified sequence opt4 from neuraminidase__InfluenzaA__AAY46384
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacgccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166787 - RNA, 1410 nt, Artificial Sequence
  derived and/or modified sequence opt4 from neuraminidase__InfluenzaA__AAY46394
augaaccccaaccagaagaucaucaccaucggcagcgugagccugaccaucgccaccaucugcuuccugaugcagaucgccauccugaucaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucgaccugaugcccaucuga

SEQ ID NO: 166788 - RNA, 1410 nt, Artificial Sequence
  derived and/or modified sequence opt4 from neuraminidase__InfluenzaA__AAY46419
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccauccuggagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacggcggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166789 - RNA, 1410 nt, Artificial Sequence
  derived and/or modified sequence opt4 from neuraminidase__InfluenzaA__AAY47016
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcaacgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacagcgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166790 - RNA, 1410 nt, Artificial Sequence
  derived and/or modified sequence opt4 from neuraminidase__InfluenzaA__AAY47055
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccuguuccccaucuga

SEQ ID NO: 166791 - RNA, 1410 nt, Artificial Sequence
  derived and/or modified sequence opt4 from neuraminidase__InfluenzaA__AAY47078
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccacgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166792 - RNA, 1410 nt, Artificial Sequence
  derived and/or modified sequence opt4 from neuraminidase__InfluenzaA__AAY47088
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166793 - RNA, 1410 nt, Artificial Sequence; identical to SEQ ID NO: 166657
  derived and/or modified sequence opt4 from neuraminidase__InfluenzaA__AAY58319

SEQ ID NO: 166794 - RNA, 1392 nt, Artificial Sequence
  derived and/or modified sequence opt4 from neuraminidase__InfluenzaA__AAY59038
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccaccaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166795 - RNA, 1410 nt, Artificial Sequence
  derived and/or modified sequence opt4 from neuraminidase__InfluenzaA__AAY64195
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggaggccgaggugugguggaccagcaacagcaucgugguguucugcggcaccagcggcaccuacggcaccggcagcuggcccgacggcgccgacaucaaccugaugcccaucuga

SEQ ID NO: 166796 - RNA, 1410 nt, Artificial Sequence; identical to SEQ ID NO: 166655
  derived and/or modified sequence opt4 from neuraminidase__InfluenzaA__AAY64205

SEQ ID NO: 166797 - RNA, 1410 nt, Artificial Sequence; identical to SEQ ID NO: 166581
  derived and/or modified sequence opt4 from neuraminidase__InfluenzaA__AAY64215

SEQ ID NO: 166798 - RNA, 1410 nt, Artificial Sequence
  derived and/or modified sequence opt4 from neuraminidase__InfluenzaA__AAY64225
augaaccccaaccagaagaucaucaccaucggcagcgugagccugaccaucgccaccaucugcuuccugaugcagaucaccauccuggugaccaccgugacccugcacuucaagcaguacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaacgaggugugguggaccagcaacagcaucgugguguucugcggcaccagcggcaccuacggcaccggcagcuggcccgacggcgccgacaucaaccugaugcccaucuga

SEQ ID NO: 166799 - RNA, 1410 nt, Artificial Sequence
  derived and/or modified sequence opt4 from neuraminidase__InfluenzaA__AAY64245
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccauccuggagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacggcggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166800 - RNA, 1410 nt, Artificial Sequence; identical to SEQ ID NO: 166581
  derived and/or modified sequence opt4 from neuraminidase__InfluenzaA__AAY64255

SEQ ID NO: 166801 - RNA, 1410 nt, Artificial Sequence; identical to SEQ ID NO: 166799
  derived and/or modified sequence opt4 from neuraminidase__InfluenzaA__AAY64265

SEQ ID NO: 166802 - RNA, 1410 nt, Artificial Sequence; identical to SEQ ID NO: 166799
  derived and/or modified sequence opt4 from neuraminidase__InfluenzaA__AAY64285

SEQ ID NO: 166803 - RNA, 1410 nt, Artificial Sequence
  derived and/or modified sequence opt4 from neuraminidase__InfluenzaA__AAY64295
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcugagcgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166804 - RNA, 1410 nt, Artificial Sequence
  derived and/or modified sequence opt4 from neuraminidase__InfluenzaA__AAY64305
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggagagaggcaacaugagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166805 - RNA, 1410 nt, Artificial Sequence; identical to SEQ ID NO: 166655
  derived and/or modified sequence opt4 from neuraminidase__InfluenzaA__AAY64335

SEQ ID NO: 166806 - RNA, 1410 nt, Artificial Sequence; identical to SEQ ID NO: 166670
  derived and/or modified sequence opt4 from neuraminidase__InfluenzaA__AAY64365

SEQ ID NO: 166807 - RNA, 1410 nt, Artificial Sequence
  derived and/or modified sequence opt4 from neuraminidase__InfluenzaA__AAY64385
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccauccuggagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacggcggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166808 - RNA, 1410 nt, Artificial Sequence
  derived and/or modified sequence opt4 from neuraminidase__InfluenzaA__AAY64395
augaaccccaaccagaagaucaucaccaucggcagcgugagccugaucaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucaaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaacagcaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166809 - RNA, 1410 nt, Artificial Sequence; identical to SEQ ID NO: 166804
  derived and/or modified sequence opt4 from neuraminidase__InfluenzaA__AAY64405

SEQ ID NO: 166810 - RNA, 1410 nt, Artificial Sequence; identical to SEQ ID NO: 166799
  derived and/or modified sequence opt4 from neuraminidase__InfluenzaA__AAY98040

SEQ ID NO: 166811 - RNA, 1410 nt, Artificial Sequence; identical to SEQ ID NO: 166799
  derived and/or modified sequence opt4 from neuraminidase__InfluenzaA__AAY98050

SEQ ID NO: 166812 - RNA, 1410 nt, Artificial Sequence; identical to SEQ ID NO: 166691
  derived and/or modified sequence opt4 from neuraminidase__InfluenzaA__AAY98060

SEQ ID NO: 166813 - RNA, 1410 nt, Artificial Sequence
  derived and/or modified sequence opt4 from neuraminidase__InfluenzaA__AAY98070
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaucuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166814 - RNA, 1410 nt, Artificial Sequence; identical to SEQ ID NO: 166699
  derived and/or modified sequence opt4 from neuraminidase__InfluenzaA__AAY98080

SEQ ID NO: 166815 - RNA, 1410 nt, Artificial Sequence
  derived and/or modified sequence opt4 from neuraminidase__InfluenzaA__AAY98090
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166816 - RNA, 1410 nt, Artificial Sequence; identical to SEQ ID NO: 166799
  derived and/or modified sequence opt4 from neuraminidase__InfluenzaA__AAY98100

SEQ ID NO: 166817 - RNA, 1410 nt, Artificial Sequence; identical to SEQ ID NO: 166799
  derived and/or modified sequence opt4 from neuraminidase__InfluenzaA__AAY98110

SEQ ID NO: 166818 - RNA, 1410 nt, Artificial Sequence; identical to SEQ ID NO: 166799
  derived and/or modified sequence opt4 from neuraminidase__InfluenzaA__AAY98120

SEQ ID NO: 166819 - RNA, 1410 nt, Artificial Sequence; identical to SEQ ID NO: 166799
  derived and/or modified sequence opt4 from neuraminidase__InfluenzaA__AAY98130

SEQ ID NO: 166820 - RNA, 1410 nt, Artificial Sequence; identical to SEQ ID NO: 166799
  derived and/or modified sequence opt4 from neuraminidase__InfluenzaA__AAY98150

SEQ ID NO: 166821 - RNA, 1410 nt, Artificial Sequence
  derived and/or modified sequence opt4 from neuraminidase__InfluenzaA__AAY98160
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccauccuggagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacggcggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcaacgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcaacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166822 - RNA, 1410 nt, Artificial Sequence; identical to SEQ ID NO: 166799
  derived and/or modified sequence opt4 from neuraminidase__InfluenzaA__AAY98170

SEQ ID NO: 166823 - RNA, 1410 nt, Artificial Sequence; identical to SEQ ID NO: 166799
  derived and/or modified sequence opt4 from neuraminidase__InfluenzaA__AAY98180

SEQ ID NO: 166824 - RNA, 1410 nt, Artificial Sequence; identical to SEQ ID NO: 166799
  derived and/or modified sequence opt4 from neuraminidase__InfluenzaA__AAY98200

SEQ ID NO: 166825 - RNA, 1410 nt, Artificial Sequence; identical to SEQ ID NO: 166799
  derived and/or modified sequence opt4 from neuraminidase__InfluenzaA__AAY98210

SEQ ID NO: 166826 - RNA, 1410 nt, Artificial Sequence; identical to SEQ ID NO: 166804
  derived and/or modified sequence opt4 from neuraminidase__InfluenzaA__AAY98220

SEQ ID NO: 166827 - RNA, 1410 nt, Artificial Sequence; identical to SEQ ID NO: 166799
  derived and/or modified sequence opt4 from neuraminidase__InfluenzaA__AAY98230

SEQ ID NO: 166828 - RNA, 1410 nt, Artificial Sequence
  derived and/or modified sequence opt4 from neuraminidase__InfluenzaA__AAY98250
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccauccuggagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacggcggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggaggacaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166829 - RNA, 1410 nt, Artificial Sequence; identical to SEQ ID NO: 166799
  derived and/or modified sequence opt4 from neuraminidase__InfluenzaA__AAY98322

SEQ ID NO: 166830 - RNA, 1410 nt, Artificial Sequence; identical to SEQ ID NO: 166804
  derived and/or modified sequence opt4 from neuraminidase__InfluenzaA__AAY98332

SEQ ID NO: 166831 - RNA, 1410 nt, Artificial Sequence; identical to SEQ ID NO: 166799
  derived and/or modified sequence opt4 from neuraminidase__InfluenzaA__AAY98342

SEQ ID NO: 166832 - RNA, 1410 nt, Artificial Sequence; identical to SEQ ID NO: 166799
  derived and/or modified sequence opt4 from neuraminidase__InfluenzaA__AAY98359

SEQ ID NO: 166833 - RNA, 1410 nt, Artificial Sequence; identical to SEQ ID NO: 166804
  derived and/or modified sequence opt4 from neuraminidase__InfluenzaA__AAY98369

SEQ ID NO: 166834 - RNA, 1410 nt, Artificial Sequence
  derived and/or modified sequence opt4 from neuraminidase__InfluenzaA__AAY98379
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacggcggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagaaacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166835 - RNA, 1410 nt, Artificial Sequence
  derived and/or modified sequence opt4 from neuraminidase__InfluenzaA__AAY98389
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacggcggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166836 - RNA, 1410 nt, Artificial Sequence; identical to SEQ ID NO: 166799
  derived and/or modified sequence opt4 from neuraminidase__InfluenzaA__AAY98399

SEQ ID NO: 166837 - RNA, 1410 nt, Artificial Sequence; identical to SEQ ID NO: 166799
  derived and/or modified sequence opt4 from neuraminidase__InfluenzaA__AAY98409

SEQ ID NO: 166838 - RNA, 1410 nt, Artificial Sequence; identical to SEQ ID NO: 166799
  derived and/or modified sequence opt4 from neuraminidase__InfluenzaA__AAY98773

SEQ ID NO: 166839 - RNA, 1410 nt, Artificial Sequence
  derived and/or modified sequence opt4 from neuraminidase__InfluenzaA__AAZ32955
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaucgugcacgagagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166840 - RNA, 1344 nt, Artificial Sequence
  derived and/or modified sequence opt4 from neuraminidase__InfluenzaA__AAZ32957
augaaccccaaccagaagaucaucaccaucggcagcgugagccugaccaucagcaccaucugcuucuucaugcagaucgccauccugaucaccaccgugacccugaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcaacgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166841 - RNA, 1344 nt, Artificial Sequence; identical to SEQ ID NO: 166840
  derived and/or modified sequence opt4 from neuraminidase__InfluenzaA__AAZ32958

SEQ ID NO: 166842 - RNA, 1344 nt, Artificial Sequence; identical to SEQ ID NO: 166840
  derived and/or modified sequence opt4 from neuraminidase__InfluenzaA__AAZ32959

SEQ ID NO: 166843 - RNA, 1410 nt, Artificial Sequence; identical to SEQ ID NO: 166804
  derived and/or modified sequence opt4 from neuraminidase__InfluenzaA__AAZ38465

SEQ ID NO: 166844 - RNA, 1410 nt, Artificial Sequence; identical to SEQ ID NO: 166804
  derived and/or modified sequence opt4 from neuraminidase__InfluenzaA__AAZ38476

SEQ ID NO: 166845 - RNA, 1410 nt, Artificial Sequence
  derived and/or modified sequence opt4 from neuraminidase__InfluenzaA__AAZ38487
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccauccuggagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacggcggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcaacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166846 - RNA, 1410 nt, Artificial Sequence
  derived and/or modified sequence opt4 from neuraminidase__InfluenzaA__AAZ38509
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaacagcaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166847 - RNA, 1410 nt, Artificial Sequence
  derived and/or modified sequence opt4 from neuraminidase__InfluenzaA__AAZ38586
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166848 - RNA, 1410 nt, Artificial Sequence; identical to SEQ ID NO: 166847
  derived and/or modified sequence opt4 from neuraminidase__InfluenzaA__AAZ38597

SEQ ID NO: 166849 - RNA, 1410 nt, Artificial Sequence
  derived and/or modified sequence opt4 from neuraminidase__InfluenzaA__AAZ38608
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaccaaccugaugcccaucuga

SEQ ID NO: 166850 - RNA, 1410 nt, Artificial Sequence
  derived and/or modified sequence opt4 from neuraminidase__InfluenzaA__AAZ38619
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166851 - RNA, 1410 nt, Artificial Sequence; identical to SEQ ID NO: 166847
  derived and/or modified sequence opt4 from neuraminidase__InfluenzaA__AAZ38641

SEQ ID NO: 166852 - RNA, 1410 nt, Artificial Sequence; identical to SEQ ID NO: 166847
  derived and/or modified sequence opt4 from neuraminidase__InfluenzaA__AAZ38653

SEQ ID NO: 166853 - RNA, 1410 nt, Artificial Sequence; identical to SEQ ID NO: 166638
  derived and/or modified sequence opt4 from neuraminidase__InfluenzaA__AAZ43386

SEQ ID NO: 166854 - RNA, 1410 nt, Artificial Sequence
  derived and/or modified sequence opt4 from neuraminidase__InfluenzaA__AAZ43397
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagagagagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166855 - RNA, 1410 nt, Artificial Sequence
  derived and/or modified sequence opt4 from neuraminidase__InfluenzaA__AAZ43408
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaugaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166856 - RNA, 1410 nt, Artificial Sequence
  derived and/or modified sequence opt4 from neuraminidase__InfluenzaA__AAZ74355
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggccaugcccugcgagcccgccaucaucgagagaaacaccaccgagaccguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166857 - RNA, 1410 nt, Artificial Sequence
  derived and/or modified sequence opt4 from neuraminidase__InfluenzaA__AAZ74366
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacaaggacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166858 - RNA, 1410 nt, Artificial Sequence
  derived and/or modified sequence opt4 from neuraminidase__InfluenzaA__AAZ74377
augaaccccaaccagaagaucaucaccaucggcagcgugagccugaccaucgccaccaucugcuuccugacccagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagagagaagcugagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 166859 - RNA, 1410 nt, Artificial Sequence
  derived and/or modified sequence opt4 from neuraminidase__InfluenzaA__AAZ74400
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagccugaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggagagaggcaacaugagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166860 - RNA, 1410 nt, Artificial Sequence; identical to SEQ ID NO: 166799
  derived and/or modified sequence opt4 from neuraminidase__InfluenzaA__AAZ74411

SEQ ID NO: 166861 - RNA, 1410 nt, Artificial Sequence
  derived and/or modified sequence opt4 from neuraminidase__InfluenzaA__AAZ74422
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacaccagcaagcugagcggcagcgcccagcacguggaggagugcagcugcuaccccagauaccccggcaucagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166862 - RNA, 1410 nt, Artificial Sequence; identical to SEQ ID NO: 166847
  derived and/or modified sequence opt4 from neuraminidase__InfluenzaA__AAZ74444

SEQ ID NO: 166863 - RNA, 1410 nt, Artificial Sequence
  derived and/or modified sequence opt4 from neuraminidase__InfluenzaA__AAZ74455
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166864 - RNA, 1410 nt, Artificial Sequence; identical to SEQ ID NO: 166847
  derived and/or modified sequence opt4 from neuraminidase__InfluenzaA__AAZ74477

SEQ ID NO: 166865 - RNA, 1410 nt, Artificial Sequence; identical to SEQ ID NO: 166863
  derived and/or modified sequence opt4 from neuraminidase__InfluenzaA__AAZ74488

SEQ ID NO: 166866 - RNA, 1410 nt, Artificial Sequence
  derived and/or modified sequence opt4 from neuraminidase__InfluenzaA__AAZ74499
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacaccagcaagcugagcggcagcgcccagcacguggaggagugcagcugcuaccccagauaccccggcaucagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166867 - RNA, 1410 nt, Artificial Sequence; identical to SEQ ID NO: 166863
  derived and/or modified sequence opt4 from neuraminidase__InfluenzaA__AAZ74510

SEQ ID NO: 166868 - RNA, 1410 nt, Artificial Sequence; identical to SEQ ID NO: 166866
  derived and/or modified sequence opt4 from neuraminidase__InfluenzaA__AAZ74521

SEQ ID NO: 166869 - RNA, 1410 nt, Artificial Sequence
  derived and/or modified sequence opt4 from neuraminidase__InfluenzaA__AAZ74532
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcaacgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 166870 - RNA, 1410 nt, Artificial Sequence; identical to SEQ ID NO: 166847
  derived and/or modified sequence opt4 from neuraminidase__InfluenzaA__AAZ74543

SEQ ID NO: 166871 - RNA, 1410 nt, Artificial Sequence; identical to SEQ ID NO: 166799
  derived and/or modified sequence opt4 from neuraminidase__InfluenzaA__AAZ74565

SEQ ID NO: 166872 - RNA, 1410 nt, Artificial Sequence; identical to SEQ ID NO: 166847
  derived and/or modified sequence opt4 from neuraminidase__InfluenzaA__AAZ74598

SEQ ID NO: 166873 - RNA, 1410 nt, Artificial Sequence
  derived and/or modified sequence opt4 from neuraminidase__InfluenzaA__AAZ74609
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaucaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucagcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcgugaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166874 - RNA, 1410 nt, Artificial Sequence; identical to SEQ ID NO: 166581
  derived and/or modified sequence opt4 from neuraminidase__InfluenzaA__AAZ74620

SEQ ID NO: 166875 - RNA, 1410 nt, Artificial Sequence; identical to SEQ ID NO: 166693
  derived and/or modified sequence opt4 from neuraminidase__InfluenzaA__AAZ79508

SEQ ID NO: 166876 - RNA, 1410 nt, Artificial Sequence
  derived and/or modified sequence opt4 from neuraminidase__InfluenzaA__AAZ79519
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccauccuggagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacggcggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcagacccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166877 - RNA, 1410 nt, Artificial Sequence; identical to SEQ ID NO: 166657
  derived and/or modified sequence opt4 from neuraminidase__InfluenzaA__AAZ79530

SEQ ID NO: 166878 - RNA, 1410 nt, Artificial Sequence
  derived and/or modified sequence opt4 from neuraminidase__InfluenzaA__AAZ79552
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaaccccccacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 166879 - RNA, 1410 nt, Artificial Sequence; identical to SEQ ID NO: 166799
  derived and/or modified sequence opt4 from neuraminidase__InfluenzaA__AAZ79563

SEQ ID NO: 166880 - RNA, 1410 nt, Artificial Sequence; identical to SEQ ID NO: 166799
  derived and/or modified sequence opt4 from neuraminidase__InfluenzaA__AAZ79574

SEQ ID NO: 166881 - RNA, 1410 nt, Artificial Sequence; identical to SEQ ID NO: 166799
  derived and/or modified sequence opt4 from neuraminidase__InfluenzaA__AAZ79585

SEQ ID NO: 166882 - RNA, 1410 nt, Artificial Sequence; identical to SEQ ID NO: 166866
  derived and/or modified sequence opt4 from neuraminidase__InfluenzaA__AAZ79618

SEQ ID NO: 166883 - RNA, 1410 nt, Artificial Sequence; identical to SEQ ID NO: 166847
  derived and/or modified sequence opt4 from neuraminidase__InfluenzaA__AAZ79633

SEQ ID NO: 166884 - RNA, 1410 nt, Artificial Sequence; identical to SEQ ID NO: 166866
  derived and/or modified sequence opt4 from neuraminidase__InfluenzaA__AAZ79945

SEQ ID NO: 166885 - RNA, 1410 nt, Artificial Sequence; identical to SEQ ID NO: 166863
  derived and/or modified sequence opt4 from neuraminidase__InfluenzaA__AAZ79966

SEQ ID NO: 166886 - RNA, 1410 nt, Artificial Sequence; identical to SEQ ID NO: 166847
  derived and/or modified sequence opt4 from neuraminidase__InfluenzaA__AAZ79977

SEQ ID NO: 166887 - RNA, 1410 nt, Artificial Sequence; identical to SEQ ID NO: 166847
  derived and/or modified sequence opt4 from neuraminidase__InfluenzaA__AAZ79988

SEQ ID NO: 166888 - RNA, 1410 nt, Artificial Sequence
  derived and/or modified sequence opt4 from neuraminidase__InfluenzaA__AAZ79999
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagaugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166889 - RNA, 1410 nt, Artificial Sequence; identical to SEQ ID NO: 166635
  derived and/or modified sequence opt4 from neuraminidase__InfluenzaA__AAZ80010

SEQ ID NO: 166890 - RNA, 1410 nt, Artificial Sequence
  derived and/or modified sequence opt4 from neuraminidase__InfluenzaA__AAZ80021
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacaccagcaagcugagcggcagcgcccagcacguggaggagugcagcugcuaccccagauaccccggcaucagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166891 - RNA, 1410 nt, Artificial Sequence
  derived and/or modified sequence opt4 from neuraminidase__InfluenzaA__AAZ83245
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagagacaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 166892 - RNA, 1413 nt, Artificial Sequence
  derived and/or modified sequence opt4 from neuraminidase__InfluenzaA__AAZ83256
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcaucgacagcgacaccgccaacuggagcuggcccgacggcgccgagcugcccuucaccaucgacaaguga

SEQ ID NO: 166893 - RNA, 1410 nt, Artificial Sequence; identical to SEQ ID NO: 166799
  derived and/or modified sequence opt4 from neuraminidase__InfluenzaA__AAZ83269

SEQ ID NO: 166894 - RNA, 1410 nt, Artificial Sequence; identical to SEQ ID NO: 166799
  derived and/or modified sequence opt4 from neuraminidase__InfluenzaA__AAZ83280

SEQ ID NO: 166895 - RNA, 1410 nt, Artificial Sequence; identical to SEQ ID NO: 166773
  derived and/or modified sequence opt4 from neuraminidase__InfluenzaA__AAZ83291

SEQ ID NO: 166896 - RNA, 1413 nt, Artificial Sequence
  derived and/or modified sequence opt4 from neuraminidase__InfluenzaA__AAZ83302
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaaggccagcgugacccuggccggcaacagcagccugugcagcaucagcggcugggccaucuacaccaaggacaacagcaucagaaucggcagcaagggcgacguguucgugaucagagagcccuucaucagcugcagccacagcgagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 166897 - RNA, 1410 nt, Artificial Sequence
  derived and/or modified sequence opt4 from neuraminidase__InfluenzaA__AAZ83315
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccaacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgccagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166898 - RNA, 1410 nt, Artificial Sequence
  derived and/or modified sequence opt4 from neuraminidase__InfluenzaA__AAZ83326
augaaccccaaccagaagaucaucaccaucggcagcgugagccugaccaucgccaccaucugcuuccugaugcagaucgccauccuggugaccaccgugacccugcacuucaagcaguacgagugcgacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 166899 - RNA, 1410 nt, Artificial Sequence
  derived and/or modified sequence opt4 from neuraminidase__InfluenzaA__AAZ83374
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaaccggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166900 - RNA, 1410 nt, Artificial Sequence; identical to SEQ ID NO: 166866
  derived and/or modified sequence opt4 from neuraminidase__InfluenzaA__AAZ83385

SEQ ID NO: 166901 - RNA, 1413 nt, Artificial Sequence
  derived and/or modified sequence opt4 from neuraminidase__InfluenzaA__AAZ85129
augaacaccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 166902 - RNA, 1410 nt, Artificial Sequence
  derived and/or modified sequence opt4 from neuraminidase__InfluenzaA__ABA06513
augaaccccaaccagaagaucaucaccaucggcagcgugagccugaccaucgccaccaucugcuuccugacccagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 166903 - RNA, 1410 nt, Artificial Sequence; identical to SEQ ID NO: 166902
  derived and/or modified sequence opt4 from neuraminidase__InfluenzaA__ABA06545

SEQ ID NO: 166904 - RNA, 1413 nt, Artificial Sequence
  derived and/or modified sequence opt4 from neuraminidase__InfluenzaA__ABA08478
augaacaccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 166905 - RNA, 1410 nt, Artificial Sequence; identical to SEQ ID NO: 166902
  derived and/or modified sequence opt4 from neuraminidase__InfluenzaA__ABA08511

SEQ ID NO: 166906 - RNA, 1413 nt, Artificial Sequence
  derived and/or modified sequence opt4 from neuraminidase__InfluenzaA__ABA12699
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 166907 - RNA, 1413 nt, Artificial Sequence; identical to SEQ ID NO: 166906
  derived and/or modified sequence opt4 from neuraminidase__InfluenzaA__ABA12710

SEQ ID NO: 166908 - RNA, 1413 nt, Artificial Sequence
  derived and/or modified sequence opt4 from neuraminidase__InfluenzaA__ABA12721
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucggcaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccagagacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 166909 - RNA, 1413 nt, Artificial Sequence; identical to SEQ ID NO: 166906
  derived and/or modified sequence opt4 from neuraminidase__InfluenzaA__ABA12732

SEQ ID NO: 166910 - RNA, 1410 nt, Artificial Sequence; identical to SEQ ID NO: 166847
  derived and/or modified sequence opt4 from neuraminidase__InfluenzaA__ABA12743

SEQ ID NO: 166911 - RNA, 1410 nt, Artificial Sequence; identical to SEQ ID NO: 166863
  derived and/or modified sequence opt4 from neuraminidase__InfluenzaA__ABA12754

SEQ ID NO: 166912 - RNA, 1410 nt, Artificial Sequence; identical to SEQ ID NO: 166866
  derived and/or modified sequence opt4 from neuraminidase__InfluenzaA__ABA12765

SEQ ID NO: 166913 - RNA, 1410 nt, Artificial Sequence; identical to SEQ ID NO: 166638
  derived and/or modified sequence opt4 from neuraminidase__InfluenzaA__ABA12776

SEQ ID NO: 166914 - RNA, 1410 nt, Artificial Sequence; identical to SEQ ID NO: 166847
  derived and/or modified sequence opt4 from neuraminidase__InfluenzaA__ABA12786

SEQ ID NO: 166915 - RNA, 1410 nt, Artificial Sequence; identical to SEQ ID NO: 166866
  derived and/or modified sequence opt4 from neuraminidase__InfluenzaA__ABA18029

SEQ ID NO: 166916 - RNA, 1413 nt, Artificial Sequence
  derived and/or modified sequence opt4 from neuraminidase__InfluenzaA__ABA18040
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 166917 - RNA, 1410 nt, Artificial Sequence
  derived and/or modified sequence opt4 from neuraminidase__InfluenzaA__ABA18126
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacauguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166918 - RNA, 1413 nt, Artificial Sequence; identical to SEQ ID NO: 166906
  derived and/or modified sequence opt4 from neuraminidase__InfluenzaA__ABA18148

SEQ ID NO: 166919 - RNA, 1410 nt, Artificial Sequence
  derived and/or modified sequence opt4 from neuraminidase__InfluenzaA__ABA18159
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacaccagcaagcugagcggcagcgcccagcacguggaggagugcagcugcuaccccagauaccccggcaucagaugcgugugcagagacaacuggaagggcagcaacagacccaucguggacgugaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166920 - RNA, 1410 nt, Artificial Sequence; identical to SEQ ID NO: 166847
  derived and/or modified sequence opt4 from neuraminidase__InfluenzaA__ABA26703

SEQ ID NO: 166921 - RNA, 1410 nt, Artificial Sequence; identical to SEQ ID NO: 166847
  derived and/or modified sequence opt4 from neuraminidase__InfluenzaA__ABA26714

SEQ ID NO: 166922 - RNA, 1410 nt, Artificial Sequence; identical to SEQ ID NO: 166847
  derived and/or modified sequence opt4 from neuraminidase__InfluenzaA__ABA26736

SEQ ID NO: 166923 - RNA, 1410 nt, Artificial Sequence; identical to SEQ ID NO: 166847
  derived and/or modified sequence opt4 from neuraminidase__InfluenzaA__ABA26747

SEQ ID NO: 166924 - RNA, 1410 nt, Artificial Sequence; identical to SEQ ID NO: 166847
  derived and/or modified sequence opt4 from neuraminidase__InfluenzaA__ABA26758

SEQ ID NO: 166925 - RNA, 1410 nt, Artificial Sequence; identical to SEQ ID NO: 166847
  derived and/or modified sequence opt4 from neuraminidase__InfluenzaA__ABA26769

SEQ ID NO: 166926 - RNA, 1410 nt, Artificial Sequence; identical to SEQ ID NO: 166847
  derived and/or modified sequence opt4 from neuraminidase__InfluenzaA__ABA26780

SEQ ID NO: 166927 - RNA, 1410 nt, Artificial Sequence; identical to SEQ ID NO: 166847
  derived and/or modified sequence opt4 from neuraminidase__InfluenzaA__ABA26791

SEQ ID NO: 166928 - RNA, 1410 nt, Artificial Sequence; identical to SEQ ID NO: 166847
  derived and/or modified sequence opt4 from neuraminidase__InfluenzaA__ABA26802

SEQ ID NO: 166929 - RNA, 1413 nt, Artificial Sequence
  derived and/or modified sequence opt4 from neuraminidase__InfluenzaA__ABA42250
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcgacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 166930 - RNA, 1413 nt, Artificial Sequence; identical to SEQ ID NO: 166916
  derived and/or modified sequence opt4 from neuraminidase__InfluenzaA__ABA42261

SEQ ID NO: 166931 - RNA, 1410 nt, Artificial Sequence
  derived and/or modified sequence opt4 from neuraminidase__InfluenzaA__ABA42272
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaagcugagacugggcuacgagaccuucaaggugaucgagggcuggagcaaccccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166932 - RNA, 1410 nt, Artificial Sequence; identical to SEQ ID NO: 166847
  derived and/or modified sequence opt4 from neuraminidase__InfluenzaA__ABA42294

SEQ ID NO: 166933 - RNA, 1410 nt, Artificial Sequence; identical to SEQ ID NO: 166674
  derived and/or modified sequence opt4 from neuraminidase__InfluenzaA__ABA42305

SEQ ID NO: 166934 - RNA, 1410 nt, Artificial Sequence; identical to SEQ ID NO: 166684
  derived and/or modified sequence opt4 from neuraminidase__InfluenzaA__ABA42316

SEQ ID NO: 166935 - RNA, 1413 nt, Artificial Sequence
  derived and/or modified sequence opt4 from neuraminidase__InfluenzaA__ABA42327
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 166936 - RNA, 1410 nt, Artificial Sequence; identical to SEQ ID NO: 166669
  derived and/or modified sequence opt4 from neuraminidase__InfluenzaA__ABA42338

SEQ ID NO: 166937 - RNA, 1410 nt, Artificial Sequence
  derived and/or modified sequence opt4 from neuraminidase__InfluenzaA__ABA42349
augaaccccaaccagaagaucaucaccaucggcagcgugagccugaccaucgccaccaucugcuuccugaugcagaucgccauccuggugaccaccgugacccugcacuucaagcaguacgagugcgacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcaagcugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166938 - RNA, 1410 nt, Artificial Sequence; identical to SEQ ID NO: 166674
  derived and/or modified sequence opt4 from neuraminidase__InfluenzaA__ABA42360

SEQ ID NO: 166939 - RNA, 1410 nt, Artificial Sequence; identical to SEQ ID NO: 166669
  derived and/or modified sequence opt4 from neuraminidase__InfluenzaA__ABA42371

SEQ ID NO: 166940 - RNA, 1410 nt, Artificial Sequence; identical to SEQ ID NO: 166684
  derived and/or modified sequence opt4 from neuraminidase__InfluenzaA__ABA42382

SEQ ID NO: 166941 - RNA, 1410 nt, Artificial Sequence; identical to SEQ ID NO: 166669
  derived and/or modified sequence opt4 from neuraminidase__InfluenzaA__ABA42393

SEQ ID NO: 166942 - RNA, 1410 nt, Artificial Sequence
  derived and/or modified sequence opt4 from neuraminidase__InfluenzaA__ABA42404
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugaacaucagcacccugcccggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166943 - RNA, 1410 nt, Artificial Sequence; identical to SEQ ID NO: 166684
  derived and/or modified sequence opt4 from neuraminidase__InfluenzaA__ABA42415

SEQ ID NO: 166944 - RNA, 1410 nt, Artificial Sequence; identical to SEQ ID NO: 166691
  derived and/or modified sequence opt4 from neuraminidase__InfluenzaA__ABA42446

SEQ ID NO: 166945 - RNA, 1410 nt, Artificial Sequence
  derived and/or modified sequence opt4 from neuraminidase__InfluenzaA__ABA42457
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagagcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166946 - RNA, 1410 nt, Artificial Sequence; identical to SEQ ID NO: 166691
  derived and/or modified sequence opt4 from neuraminidase__InfluenzaA__ABA42468

SEQ ID NO: 166947 - RNA, 1410 nt, Artificial Sequence
  derived and/or modified sequence opt4 from neuraminidase__InfluenzaA__ABA42479
augaaccccaaccagaagaucaucaccaucggcagcgugagccugaccaucgccaccaucugcuuccugaugcagaucgccauccuggugaccaccgugacccugcacuucaagcaguacgagugcgacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggacggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166948 - RNA, 1410 nt, Artificial Sequence
  derived and/or modified sequence opt4 from neuraminidase__InfluenzaA__ABA42490
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcaagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucaagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 166949 - RNA, 1410 nt, Artificial Sequence; identical to SEQ ID NO: 166691
  derived and/or modified sequence opt4 from neuraminidase__InfluenzaA__ABA42501

SEQ ID NO: 166950 - RNA, 1410 nt, Artificial Sequence
  derived and/or modified sequence opt4 from neuraminidase__InfluenzaA__ABA42512
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccccaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166951 - RNA, 1410 nt, Artificial Sequence; identical to SEQ ID NO: 166581
  derived and/or modified sequence opt4 from neuraminidase__InfluenzaA__ABA42523

SEQ ID NO: 166952 - RNA, 1410 nt, Artificial Sequence; identical to SEQ ID NO: 166581
  derived and/or modified sequence opt4 from neuraminidase__InfluenzaA__ABA42534

SEQ ID NO: 166953 - RNA, 1410 nt, Artificial Sequence; identical to SEQ ID NO: 166773
  derived and/or modified sequence opt4 from neuraminidase__InfluenzaA__ABA42545

SEQ ID NO: 166954 - RNA, 1410 nt, Artificial Sequence
  derived and/or modified sequence opt4 from neuraminidase__InfluenzaA__ABA42556
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggaggccgaggugcuguggaccagcaacagcaucgugguguucugcggcaccagcggcaccuacggcaccggcagcuggcccgacggcgccgacaucaaccugaugcccaucuga

SEQ ID NO: 166955 - RNA, 1410 nt, Artificial Sequence; identical to SEQ ID NO: 166581
  derived and/or modified sequence opt4 from neuraminidase__InfluenzaA__ABA42567

SEQ ID NO: 166956 - RNA, 1410 nt, Artificial Sequence
  derived and/or modified sequence opt4 from neuraminidase__InfluenzaA__ABA42931
augaaccccaaccagaagaucaucaccaucggcagcgugagccugaccaucgccaccaucugcagccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166957 - RNA, 1410 nt, Artificial Sequence; identical to SEQ ID NO: 166581
  derived and/or modified sequence opt4 from neuraminidase__InfluenzaA__ABA42942

SEQ ID NO: 166958 - RNA, 1410 nt, Artificial Sequence; identical to SEQ ID NO: 166581
  derived and/or modified sequence opt4 from neuraminidase__InfluenzaA__ABA42981

SEQ ID NO: 166959 - RNA, 1410 nt, Artificial Sequence; identical to SEQ ID NO: 166669
  derived and/or modified sequence opt4 from neuraminidase__InfluenzaA__ABA42992

SEQ ID NO: 166960 - RNA, 1413 nt, Artificial Sequence
  derived and/or modified sequence opt4 from neuraminidase__InfluenzaA__ABA43192
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugauccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacguggugagcaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 166961 - RNA, 1410 nt, Artificial Sequence; identical to SEQ ID NO: 166866
  derived and/or modified sequence opt4 from neuraminidase__InfluenzaA__ABA43203

SEQ ID NO: 166962 - RNA, 1410 nt, Artificial Sequence
  derived and/or modified sequence opt4 from neuraminidase__InfluenzaA__ABA43339
augaaccccaaccagaagaucaucaccaucggcagcgugagccugagcaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcauggccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccgacaucaaccugaugcccaucuga

SEQ ID NO: 166963 - RNA, 1410 nt, Artificial Sequence
  derived and/or modified sequence opt4 from neuraminidase__InfluenzaA__ABA54916
augaaccccaaccagaagaucaucaccaccggcagcaucugcauggugaucggcauggugagccugaugcugcagaucggcaacaucaucagcaucugggugagccacagcauccagaccggcacccagcacagagccgagcccugcaacagaagcaucaucaacuacgagaacaacaccugggugaaccagaccuacgugaagaucagcaacaccaacuuccugaccgagaaggccguggccagcgugagacuggugggcaacagcagccugugccccaucagcggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagagcccaggagagcgagugcgccugcgugaacggcagcugcuucaccgugaugaccgacggccccagcaacggccaggccagcuacaagaucuucaagaucgagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 166964 - RNA, 1413 nt, Artificial Sequence
  derived and/or modified sequence opt4 from neuraminidase__InfluenzaA__ABA87048
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacaagaucuucaagaucgagaagggcaaggugaccaagagcguggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 166965 - RNA, 1413 nt, Artificial Sequence
  derived and/or modified sequence opt4 from neuraminidase__InfluenzaA__ABA87060
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcaccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcagccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 166966 - RNA, 1413 nt, Artificial Sequence
  derived and/or modified sequence opt4 from neuraminidase__InfluenzaA__ABA87083
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagaagaucaucaccuacaagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcguguucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 166967 - RNA, 1413 nt, Artificial Sequence
  derived and/or modified sequence opt4 from neuraminidase__InfluenzaA__ABA87234
augaacagcaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaucaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 166968 - RNA, 1410 nt, Artificial Sequence; identical to SEQ ID NO: 166902
  derived and/or modified sequence opt4 from neuraminidase__InfluenzaA__ABB02784

SEQ ID NO: 166969 - RNA, 1413 nt, Artificial Sequence; identical to SEQ ID NO: 166906
  derived and/or modified sequence opt4 from neuraminidase__InfluenzaA__ABB02795

SEQ ID NO: 166970 - RNA, 1413 nt, Artificial Sequence; identical to SEQ ID NO: 166906
  derived and/or modified sequence opt4 from neuraminidase__InfluenzaA__ABB02806

SEQ ID NO: 166971 - RNA, 1413 nt, Artificial Sequence
  derived and/or modified sequence opt4 from neuraminidase__InfluenzaA__ABB02817
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcguggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 166972 - RNA, 1413 nt, Artificial Sequence; identical to SEQ ID NO: 166971
  derived and/or modified sequence opt4 from neuraminidase__InfluenzaA__ABB02828

SEQ ID NO: 166973 - RNA, 1410 nt, Artificial Sequence
  derived and/or modified sequence opt4 from neuraminidase__InfluenzaA__ABB02839
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagguggugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166974 - RNA, 1410 nt, Artificial Sequence
  derived and/or modified sequence opt4 from neuraminidase__InfluenzaA__ABB02850
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcgccguggugaucaccgacggcagcgccagcggcaaggccgacaccaagauccuguucaucgaggagggcaagaucgugcacaccagcaagcugagcggcagcgcccagcacguggaggagugcagcugcuaccccagauaccccggcaucagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccugugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166975 - RNA, 1410 nt, Artificial Sequence
  derived and/or modified sequence opt4 from neuraminidase__InfluenzaA__ABB02861
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugaacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucgaccugaugcccaucuga

SEQ ID NO: 166976 - RNA, 1410 nt, Artificial Sequence; identical to SEQ ID NO: 166773
  derived and/or modified sequence opt4 from neuraminidase__InfluenzaA__ABB02872

SEQ ID NO: 166977 - RNA, 1410 nt, Artificial Sequence; identical to SEQ ID NO: 166773
  derived and/or modified sequence opt4 from neuraminidase__InfluenzaA__ABB02883

SEQ ID NO: 166978 - RNA, 1410 nt, Artificial Sequence
  derived and/or modified sequence opt4 from neuraminidase__InfluenzaA__ABB02894
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaugguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 166979 - RNA, 1410 nt, Artificial Sequence; identical to SEQ ID NO: 166581
  derived and/or modified sequence opt4 from neuraminidase__InfluenzaA__ABB02905

SEQ ID NO: 166980 - RNA, 1413 nt, Artificial Sequence
  derived and/or modified sequence opt4 from neuraminidase__InfluenzaA__ABB02916
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccagagacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 166981 - RNA, 1413 nt, Artificial Sequence
  derived and/or modified sequence opt4 from neuraminidase__InfluenzaA__ABB02927
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 166982 - RNA, 1413 nt, Artificial Sequence
  derived and/or modified sequence opt4 from neuraminidase__InfluenzaA__ABB02939
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccuggaugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 166983 - RNA, 1410 nt, Artificial Sequence; identical to SEQ ID NO: 166898
  derived and/or modified sequence opt4 from neuraminidase__InfluenzaA__ABB02950

SEQ ID NO: 166984 - RNA, 1410 nt, Artificial Sequence; identical to SEQ ID NO: 166799
  derived and/or modified sequence opt4 from neuraminidase__InfluenzaA__ABB02961

SEQ ID NO: 166985 - RNA, 1410 nt, Artificial Sequence; identical to SEQ ID NO: 166799
  derived and/or modified sequence opt4 from neuraminidase__InfluenzaA__ABB02972

SEQ ID NO: 166986 - RNA, 1410 nt, Artificial Sequence; identical to SEQ ID NO: 166799
  derived and/or modified sequence opt4 from neuraminidase__InfluenzaA__ABB02983

SEQ ID NO: 166987 - RNA, 1410 nt, Artificial Sequence; identical to SEQ ID NO: 166799
  derived and/or modified sequence opt4 from neuraminidase__InfluenzaA__ABB02994

SEQ ID NO: 166988 - RNA, 1410 nt, Artificial Sequence; identical to SEQ ID NO: 166799
  derived and/or modified sequence opt4 from neuraminidase__InfluenzaA__ABB03005

SEQ ID NO: 166989 - RNA, 1410 nt, Artificial Sequence; identical to SEQ ID NO: 166804
  derived and/or modified sequence opt4 from neuraminidase__InfluenzaA__ABB03016

SEQ ID NO: 166990 - RNA, 1410 nt, Artificial Sequence; identical to SEQ ID NO: 166799
  derived and/or modified sequence opt4 from neuraminidase__InfluenzaA__ABB03027

SEQ ID NO: 166991 - RNA, 1410 nt, Artificial Sequence; identical to SEQ ID NO: 166804
  derived and/or modified sequence opt4 from neuraminidase__InfluenzaA__ABB03038

SEQ ID NO: 166992 - RNA, 1410 nt, Artificial Sequence; identical to SEQ ID NO: 166799
  derived and/or modified sequence opt4 from neuraminidase__InfluenzaA__ABB03049

SEQ ID NO: 166993 - RNA, 1410 nt, Artificial Sequence
  derived and/or modified sequence opt4 from neuraminidase__InfluenzaA__ABB03060
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcaucagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166994 - RNA, 1410 nt, Artificial Sequence
  derived and/or modified sequence opt4 from neuraminidase__InfluenzaA__ABB03071
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166995 - RNA, 1410 nt, Artificial Sequence
  derived and/or modified sequence opt4 from neuraminidase__InfluenzaA__ABB03093
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacaucgaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 166996 - RNA, 1410 nt, Artificial Sequence; identical to SEQ ID NO: 166902
  derived and/or modified sequence opt4 from neuraminidase__InfluenzaA__ABB03104

SEQ ID NO: 166997 - RNA, 1410 nt, Artificial Sequence
  derived and/or modified sequence opt4 from neuraminidase__InfluenzaA__ABB03115
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaacgaggugcuguggaccagcaacagcaucgugguguucugcggcaccagcggcaccuacggcaccggcagcuggcccgacggcgccgacaucaaccugaugcccaucuga

SEQ ID NO: 166998 - RNA, 1413 nt, Artificial Sequence; identical to SEQ ID NO: 166906
  derived and/or modified sequence opt4 from neuraminidase__InfluenzaA__ABB03126

SEQ ID NO: 166999 - RNA, 1413 nt, Artificial Sequence
  derived and/or modified sequence opt4 from neuraminidase__InfluenzaA__ABB03148
augaaccccaaccagaagaucaucaccaucggcagcaucagcaucgccaucggcaccaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 167000 - RNA, 1410 nt, Artificial Sequence
  derived and/or modified sequence opt4 from neuraminidase__InfluenzaA__ABB04286
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagagccagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167001 - RNA, 1410 nt, Artificial Sequence
  derived and/or modified sequence opt4 from neuraminidase__InfluenzaA__ABB04297
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugauccccugcgagcccaucaccaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167002 - RNA, 1410 nt, Artificial Sequence
  derived and/or modified sequence opt4 from neuraminidase__InfluenzaA__ABB04319
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugccagaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccgacaucaaccugaugcccaucuga

SEQ ID NO: 167003 - RNA, 1410 nt, Artificial Sequence
  derived and/or modified sequence opt4 from neuraminidase__InfluenzaA__ABB04341
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcgugagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaagaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167004 - RNA, 1410 nt, Artificial Sequence
  derived and/or modified sequence opt4 from neuraminidase__InfluenzaA__ABB04352
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167005 - RNA, 1410 nt, Artificial Sequence
  derived and/or modified sequence opt4 from neuraminidase__InfluenzaA__ABB04374
augaaccccaaccagaagaucaucaccaucggcagcgugagccugaccaucgccaccgugugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagauacgugugcagcggccuggugggcgacacccccagaaacaacgacaagagcagcaacagcaacugcagaaaccccaacaacgacaagggcaaccacggcgugaagggcugggccuucgacgacggcaacgacguguggaugggcagaaccaucagcaaggacagcagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccaaggugugguggaccagcaacagcaucgugguguucugcggcaccagcggcaccuacggcaccggcagcuggcccgacggcgccgacaucaaccugaugcccaucuga

SEQ ID NO: 167006 - RNA, 1410 nt, Artificial Sequence
  derived and/or modified sequence opt4 from neuraminidase__InfluenzaA__ABB04931
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcagcagcuacugcagaaaccccaacaacgagaagggcaagcacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167007 - RNA, 1410 nt, Artificial Sequence
  derived and/or modified sequence opt4 from neuraminidase__InfluenzaA__ABB04942
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167008 - RNA, 1410 nt, Artificial Sequence; identical to SEQ ID NO: 167004
  derived and/or modified sequence opt4 from neuraminidase__InfluenzaA__ABB04953

SEQ ID NO: 167009 - RNA, 1410 nt, Artificial Sequence; identical to SEQ ID NO: 166902
  derived and/or modified sequence opt4 from neuraminidase__InfluenzaA__ABB04975

SEQ ID NO: 167010 - RNA, 1410 nt, Artificial Sequence; identical to SEQ ID NO: 166700
  derived and/or modified sequence opt4 from neuraminidase__InfluenzaA__ABB04986

SEQ ID NO: 167011 - RNA, 1410 nt, Artificial Sequence
  derived and/or modified sequence opt4 from neuraminidase__InfluenzaA__ABB04997
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucgugcaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaagcccaucuga

SEQ ID NO: 167012 - RNA, 1410 nt, Artificial Sequence; identical to SEQ ID NO: 166773
  derived and/or modified sequence opt4 from neuraminidase__InfluenzaA__ABB05008

SEQ ID NO: 167013 - RNA, 1410 nt, Artificial Sequence; identical to SEQ ID NO: 166581
  derived and/or modified sequence opt4 from neuraminidase__InfluenzaA__ABB05186

SEQ ID NO: 167014 - RNA, 1410 nt, Artificial Sequence; identical to SEQ ID NO: 166773
  derived and/or modified sequence opt4 from neuraminidase__InfluenzaA__ABB05219

SEQ ID NO: 167015 - RNA, 1410 nt, Artificial Sequence
  derived and/or modified sequence opt4 from neuraminidase__InfluenzaA__ABB46395
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaagcaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcagcagcuacugcagaaaccccaacaacgagaagggcacccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167016 - RNA, 1410 nt, Artificial Sequence; identical to SEQ ID NO: 166560
  derived and/or modified sequence opt4 from neuraminidase__InfluenzaA__ABB46417

SEQ ID NO: 167017 - RNA, 1410 nt, Artificial Sequence
  derived and/or modified sequence opt4 from neuraminidase__InfluenzaA__ABB46428
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167018 - RNA, 1410 nt, Artificial Sequence
  derived and/or modified sequence opt4 from neuraminidase__InfluenzaA__ABB46439
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcgccugcaccguggugaugaccgacggcagcgccagcggcaaggccgacaccaagauccuguucaucgaggagagaagaaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagcaacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcgccuacggcaccggcagcuggcccgacggcgccgacaucaaccugaugcccaucuga

SEQ ID NO: 167019 - RNA, 1410 nt, Artificial Sequence; identical to SEQ ID NO: 166866
  derived and/or modified sequence opt4 from neuraminidase__InfluenzaA__ABB46450

SEQ ID NO: 167020 - RNA, 1410 nt, Artificial Sequence; identical to SEQ ID NO: 166847
  derived and/or modified sequence opt4 from neuraminidase__InfluenzaA__ABB46461

SEQ ID NO: 167021 - RNA, 1410 nt, Artificial Sequence
  derived and/or modified sequence opt4 from neuraminidase__InfluenzaA__ABB46550
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcgugaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagagccagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167022 - RNA, 1410 nt, Artificial Sequence
  derived and/or modified sequence opt4 from neuraminidase__InfluenzaA__ABB51955
augaaccccaaccagaagaucaucaccaucggcagcgugagccugaccaucagcaccaucugcuucuucaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaucgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaaguucuucagaacccaggagagcgagugcgugugcauccacggcaccugcaccguggugaugaccgacggcagcgccagcagaaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167023 - RNA, 1413 nt, Artificial Sequence
  derived and/or modified sequence opt4 from neuraminidase__InfluenzaA__ABB51956
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugaccguggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcccauccugggcacccaggagagcgagugggugugcgugaacggcagcugcuucaccaucaugaccgacgaccccagcuacgaggccgccagcuacaagaucuucaagaucgagagagagagagugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167024 - RNA, 1410 nt, Artificial Sequence
  derived and/or modified sequence opt4 from neuraminidase__InfluenzaA__ABB51957
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugagagacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagaucuucagaacccagaaguucgagugcgugugcauccacuggaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167025 - RNA, 1413 nt, Artificial Sequence
  derived and/or modified sequence opt4 from neuraminidase__InfluenzaA__ABB51958
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugagcaucaacaacaccaacgugaucgccggcaaggacaagaccagcgugacccuggccggcaacagcagccugugccccaucagaggcugggccaucuacaccaagggcaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcagauaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcgugggcaucggcagaaccaucagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167026 - RNA, 1410 nt, Artificial Sequence
  derived and/or modified sequence opt4 from neuraminidase__InfluenzaA__ABB51959
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaacgaggagggcaagaucgugcacaccagcaccugcagcggcagcgcccagcacguggaggagugcagcugcuacagcagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcagagccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167027 - RNA, 1413 nt, Artificial Sequence
  derived and/or modified sequence opt4 from neuraminidase__InfluenzaA__ABB51960
augaaccccaaccagaagaucaucaccaucggcagcaucagcaucgccaucggcaucaucagccugaugcugcagaucggcaacaucauccccaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcgaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaagaucaccaagagcaucgagcugaacgcccccaacagccacuacgaggagugcagcugcuaccccgacaccggcaccgugaugugcgugugcagagacagcuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacgaguacggcaacggcgacuggaucggcagaaccaagagcaacagacugagaaagggcuucgagaugaucugggaccccgacggcuggaccgacaccaacagcgacuucagcgugaagcaggacgugguggccaucaccgacuggagcggcuacagcggcagcuucgugcagcaccccgagcugaccggccuggugugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167028 - RNA, 1410 nt, Artificial Sequence; identical to SEQ ID NO: 166863
  derived and/or modified sequence opt4 from neuraminidase__InfluenzaA__ABB53617

SEQ ID NO: 167029 - RNA, 1410 nt, Artificial Sequence
  derived and/or modified sequence opt4 from neuraminidase__InfluenzaA__ABB53721
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcagcggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167030 - RNA, 1410 nt, Artificial Sequence
  derived and/or modified sequence opt4 from neuraminidase__InfluenzaA__ABB53754
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167031 - RNA, 1410 nt, Artificial Sequence; identical to SEQ ID NO: 166623
  derived and/or modified sequence opt4 from neuraminidase__InfluenzaA__ABB54517

SEQ ID NO: 167032 - RNA, 1410 nt, Artificial Sequence
  derived and/or modified sequence opt4 from neuraminidase__InfluenzaA__ABB59999
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugaccuucugcggcaccagcggcaccuacggcaccggcagcuggcccgacggcgccgacaucaaccugaugcccaucuga

SEQ ID NO: 167033 - RNA, 1410 nt, Artificial Sequence
  derived and/or modified sequence opt4 from neuraminidase__InfluenzaA__ABB60010
augaaccccaaccagaagaucaucaccaucggcagcgugagccugaccaucgccaccaucugcuuccugaugcagaucgccauccuggugaccaccgugacccugcacuucaagcaguacgaguacagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagauacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167034 - RNA, 1410 nt, Artificial Sequence
  derived and/or modified sequence opt4 from neuraminidase__InfluenzaA__ABB77867
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167035 - RNA, 1410 nt, Artificial Sequence; identical to SEQ ID NO: 167034
  derived and/or modified sequence opt4 from neuraminidase__InfluenzaA__ABB79719

SEQ ID NO: 167036 - RNA, 1410 nt, Artificial Sequence
  derived and/or modified sequence opt4 from neuraminidase__InfluenzaA__ABB79734
augaaccccaaccagaagaucaucaccaucggcagcgugagccugacccugagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167037 - RNA, 1410 nt, Artificial Sequence; identical to SEQ ID NO: 167007
  derived and/or modified sequence opt4 from neuraminidase__InfluenzaA__ABB79791

SEQ ID NO: 167038 - RNA, 1410 nt, Artificial Sequence
  derived and/or modified sequence opt4 from neuraminidase__InfluenzaA__ABB79802
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167039 - RNA, 1410 nt, Artificial Sequence
  derived and/or modified sequence opt4 from neuraminidase__InfluenzaA__ABB79813
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggaggugugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167040 - RNA, 1410 nt, Artificial Sequence; identical to SEQ ID NO: 167039
  derived and/or modified sequence opt4 from neuraminidase__InfluenzaA__ABB79960

SEQ ID NO: 167041 - RNA, 1410 nt, Artificial Sequence; identical to SEQ ID NO: 167039
  derived and/or modified sequence opt4 from neuraminidase__InfluenzaA__ABB79971

SEQ ID NO: 167042 - RNA, 1413 nt, Artificial Sequence
  derived and/or modified sequence opt4 from neuraminidase__InfluenzaA__ABB79982
augaacgccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167043 - RNA, 1413 nt, Artificial Sequence; identical to SEQ ID NO: 166971
  derived and/or modified sequence opt4 from neuraminidase__InfluenzaA__ABB79993

SEQ ID NO: 167044 - RNA, 1410 nt, Artificial Sequence
  derived and/or modified sequence opt4 from neuraminidase__InfluenzaA__ABB80004
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaccgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167045 - RNA, 1410 nt, Artificial Sequence; identical to SEQ ID NO: 167029
  derived and/or modified sequence opt4 from neuraminidase__InfluenzaA__ABB80015

SEQ ID NO: 167046 - RNA, 1410 nt, Artificial Sequence
  derived and/or modified sequence opt4 from neuraminidase__InfluenzaA__ABB80037
augaaccccaaccagaagaucaucaccaucggcagcgugagccugaccaucgccaccgugugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaacaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacguggaggacuacagcaucgacagcagcuacgugugcagcggccuggugggcgacacccccagaaacaacgacagaagcagcaacagcaacugcagaaaccccaacaacgagagaggcaaccacggcgugaagggcugggccuucgacgacggcaacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167047 - RNA, 1413 nt, Artificial Sequence
  derived and/or modified sequence opt4 from neuraminidase__InfluenzaA__ABB80048
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcguggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacggcgacaccgccaacuggagcuggcccgacggcgccgagcugcccuucaccaucgacaaguga

SEQ ID NO: 167048 - RNA, 1410 nt, Artificial Sequence
  derived and/or modified sequence opt4 from neuraminidase__InfluenzaA__ABB80084
augaaccccaaccagaagaucaucaccaucggcagcgugagccugaccaucgccaccaucugcuuccugaugcagaucgccauccuggugaccaccgugacccugcacuucaagcaguacgagugcaacagccccagcaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167049 - RNA, 1410 nt, Artificial Sequence; identical to SEQ ID NO: 167034
  derived and/or modified sequence opt4 from neuraminidase__InfluenzaA__ABB80095

SEQ ID NO: 167050 - RNA, 1410 nt, Artificial Sequence; identical to SEQ ID NO: 167034
  derived and/or modified sequence opt4 from neuraminidase__InfluenzaA__ABB80162

SEQ ID NO: 167051 - RNA, 1410 nt, Artificial Sequence; identical to SEQ ID NO: 167034
  derived and/or modified sequence opt4 from neuraminidase__InfluenzaA__ABB80199

SEQ ID NO: 167052 - RNA, 1410 nt, Artificial Sequence
  derived and/or modified sequence opt4 from neuraminidase__InfluenzaA__ABB80210
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucggccugaugcccaucuga

SEQ ID NO: 167053 - RNA, 1410 nt, Artificial Sequence
  derived and/or modified sequence opt4 from neuraminidase__InfluenzaA__ABB80232
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacuggccgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcgacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167054 - RNA, 1410 nt, Artificial Sequence
  derived and/or modified sequence opt4 from neuraminidase__InfluenzaA__ABB80243
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagaaggagaacgaggugugguggaccagcaacagcaucgugguguucugcggcaccagcggcaccuacggcaccggcagcuggcccgacggcgccgacaucaaccugaugcccaucuga

SEQ ID NO: 167055 - RNA, 1410 nt, Artificial Sequence
  derived and/or modified sequence opt4 from neuraminidase__InfluenzaA__ABB80254
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcggccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaucugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167056 - RNA, 1410 nt, Artificial Sequence; identical to SEQ ID NO: 166647
  derived and/or modified sequence opt4 from neuraminidase__InfluenzaA__ABB80495

SEQ ID NO: 167057 - RNA, 1410 nt, Artificial Sequence; identical to SEQ ID NO: 167034
  derived and/or modified sequence opt4 from neuraminidase__InfluenzaA__ABB80506

SEQ ID NO: 167058 - RNA, 1410 nt, Artificial Sequence; identical to SEQ ID NO: 167034
  derived and/or modified sequence opt4 from neuraminidase__InfluenzaA__ABB80517

SEQ ID NO: 167059 - RNA, 1410 nt, Artificial Sequence; identical to SEQ ID NO: 167034
  derived and/or modified sequence opt4 from neuraminidase__InfluenzaA__ABB80532

SEQ ID NO: 167060 - RNA, 1410 nt, Artificial Sequence
  derived and/or modified sequence opt4 from neuraminidase__InfluenzaA__ABB80644
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaacaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167061 - RNA, 1410 nt, Artificial Sequence
  derived and/or modified sequence opt4 from neuraminidase__InfluenzaA__ABB80664
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaaggugcuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167062 - RNA, 1410 nt, Artificial Sequence
  derived and/or modified sequence opt4 from neuraminidase__InfluenzaA__ABB80675
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacuggccgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcgacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167063 - RNA, 1410 nt, Artificial Sequence
  derived and/or modified sequence opt4 from neuraminidase__InfluenzaA__ABB80685
augaaccccaaccagaagaucaucaccaucggcagcgugagccugaccaucgccaccaucugcuuccugaugcagaucgccauccuggugaucaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167064 - RNA, 1410 nt, Artificial Sequence; identical to SEQ ID NO: 167034
  derived and/or modified sequence opt4 from neuraminidase__InfluenzaA__ABB80696

SEQ ID NO: 167065 - RNA, 1410 nt, Artificial Sequence
  derived and/or modified sequence opt4 from neuraminidase__InfluenzaA__ABB80707
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcggccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167066 - RNA, 1410 nt, Artificial Sequence; identical to SEQ ID NO: 167034
  derived and/or modified sequence opt4 from neuraminidase__InfluenzaA__ABB80716

SEQ ID NO: 167067 - RNA, 1410 nt, Artificial Sequence
  derived and/or modified sequence opt4 from neuraminidase__InfluenzaA__ABB80725
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcugugcgagcccaccgugaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucguggccuucugcggcaccagcggcaccuacggcaccggcagcuggcccgacggcgccgacaucaaccugaugcccaucuga

SEQ ID NO: 167068 - RNA, 1410 nt, Artificial Sequence
  derived and/or modified sequence opt4 from neuraminidase__InfluenzaA__ABB80740
augaaccccaaccagaagaucaucaccaucggcagcgugagccugaccaucgccaccaucugcuuccugaugcagaucgccauccuggugaccaccgugacccugcacuucaagcaguacgagugcugcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucguggccuucugcggcaccagcggcaccuacggcaccggcagcuggcccgacggcgccgacaucaaccugaugcccaucuga

SEQ ID NO: 167069 - RNA, 1410 nt, Artificial Sequence; identical to SEQ ID NO: 167034
  derived and/or modified sequence opt4 from neuraminidase__InfluenzaA__ABB80751

SEQ ID NO: 167070 - RNA, 1410 nt, Artificial Sequence; identical to SEQ ID NO: 166753
  derived and/or modified sequence opt4 from neuraminidase__InfluenzaA__ABB82186

SEQ ID NO: 167071 - RNA, 1413 nt, Artificial Sequence; identical to SEQ ID NO: 166916
  derived and/or modified sequence opt4 from neuraminidase__InfluenzaA__ABB82197

SEQ ID NO: 167072 - RNA, 1413 nt, Artificial Sequence; identical to SEQ ID NO: 166906
  derived and/or modified sequence opt4 from neuraminidase__InfluenzaA__ABB82208

SEQ ID NO: 167073 - RNA, 1413 nt, Artificial Sequence
  derived and/or modified sequence opt4 from neuraminidase__InfluenzaA__ABB82219
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugaucgccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagcaaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacgccgccgacuggagcuggcccgacggcgccgagcugcccuucaccaucgacaaguga

SEQ ID NO: 167074 - RNA, 1410 nt, Artificial Sequence
  derived and/or modified sequence opt4 from neuraminidase__InfluenzaA__ABB82230
augaaccccaaccagaagaucaucaccaucggcagcgugagccugaccaucgccaccgugugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccaucguggacaucaacgugaaggacuacagcaucgacagcagauacgugugcagcggccuggugggcgacacccccagaaacaacgacagaagcagcaacagcaacugcagaaaccccaacaacgacaagggcaaccacggcgugaagggcugggccuucgacgacggcaacgacguguggaugggcagaaccaucagcaaggacagcagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167075 - RNA, 1410 nt, Artificial Sequence
  derived and/or modified sequence opt4 from neuraminidase__InfluenzaA__ABB83018
augaaccccaaccagaagaucaucaccaucggcagcgugagccugaccaucgccaccaucugcuuccugacccagaucgccauccuggugaccaccgugacccugcacuucaagcaguacggcugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 167076 - RNA, 1410 nt, Artificial Sequence; identical to SEQ ID NO: 167075
  derived and/or modified sequence opt4 from neuraminidase__InfluenzaA__ABB83029

SEQ ID NO: 167077 - RNA, 1410 nt, Artificial Sequence; identical to SEQ ID NO: 166902
  derived and/or modified sequence opt4 from neuraminidase__InfluenzaA__ABB83130

SEQ ID NO: 167078 - RNA, 1410 nt, Artificial Sequence
  derived and/or modified sequence opt4 from neuraminidase__InfluenzaA__ABB83141
augaaccccaaccagaagaucaucaccaucggcagcgugagccugaccaucgccaccaucugcuuccugagccagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 167079 - RNA, 1410 nt, Artificial Sequence
  derived and/or modified sequence opt4 from neuraminidase__InfluenzaA__ABB86876
augaacaccaaccagagaaucaucaccaucggcaccgugugccugaucgugggcaucaucagccugcugcugcagaucggcaacaucgugagccuguggaucagccacagcauccagaccggcggcaagaaccacagcgagaugugcaaccagaacgugaucaccuacgugaacaacaccugggugaacagaaccuacgugaacaucagcaacaccaacaucgccaccgugcaggacgugaccagcgugauccuggccggcaacagcagccugugcagcgugagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacaagcacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaugaacggcagcugcuucaccgugcugaccgacggccccagcaacggccaggccagcuacaagaucuucaagguggagaagggcaagaucaucaagagcaucgagcuggacgcccccaacuaccacuacgaggagugcagcugcuaccccgacaccggcaaggugaugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucaacagcagaagcggcuucgagaugaucugggaccccaacggcuggaccggcaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucugggccagcggcagcagcaucagcuucugcggcguggacagcgagaccaccagcuggagcuggcccgacggcgccgaccugcccuucaccaucgacaaguga

SEQ ID NO: 167080 - RNA, 1410 nt, Artificial Sequence
  derived and/or modified sequence opt4 from neuraminidase__InfluenzaA__ABB86886
augaacaccaaccagagaaucaucaccaucggcaccgccugccuggccaucggcaucgugagccugcugcugcagaucggcaacaucgugagccuguggaucagccacagcauccagaccgaggagaagaaccacagcgagaccugcagccagaacuucaucacccacgagaacaacaccugggugaaccagaccuacaucaacaucagcaacaccaacaacguggugggccagggcgugaccagcaucaugcuggccggcaacagcagccugugccccaucagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacaagcacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccguguucaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagaucuucaagauggagaagggcaagaucaucaagagcguggagcuggacgcccccaacuaccacuacgaggagagcagcugcuaccccgacaccggcaagguggugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcugagcaacggcgccaacggcgugaaggaggugagcuucagauacggcaacggcguguggaucggcagaaccaagagcaucagcagcagaagcggcuucgagaugaucugggaccccaacggcuggaccgagaccgacagcagcuucagcaucaagcaggacaucaucgcccugaccgacuggagcggcuacagcggcagcuucgugcagcaccccgagcugaccggcaugaacugcaucaagcccugcuucuggguggagcugaucagaggccagcccaaggagagcaccaucuggaccagcggcagcagcaucagcuucugcggcguggacagcgagaccgccagcuggagcuggcccgacggcgccgaccugcccuucaccaucgacaaguga

SEQ ID NO: 167081 - RNA, 1410 nt, Artificial Sequence
  derived and/or modified sequence opt4 from neuraminidase__InfluenzaA__ABB86898
augaaccccaaccagaagaucaucaccaucggcagcgugagccugacccuggccaccaucugcuuccugaugcagaucgccauccuggugaccaccgugacccugcacuucaagcagcaggagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacaacaccgugcacgacagaacccccuacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcagcagaagcggcuacagcggcaucuucagcguggagggcaagagcugcaucaacagaugcuucuacguggagcugaucagaggcagaaaggaggagaccaaggugugguggaccagcaacagcaucgugguguucugcggcaccagcggcaccuacggcaccggcagcuggcccgacggcgccgacaucaaccugaugcccaucuga

SEQ ID NO: 167082 - RNA, 1410 nt, Artificial Sequence
  derived and/or modified sequence opt4 from neuraminidase__InfluenzaA__ABB86906
augaacaccaaccagagaaucaucaccaucggcaccgugugccugaucgugggcaucaucagccugcugcugcagaucggcaacaucgugagccuguggaucagccacagcauccagaccggcggcaagaaccacagcgagaugugcaaccagaacgugaucaccuacgugaacaacaccugggugaacagaaccuacgugaacaucagcaacaccaacaucgccaccgugcaggacgugaccagcgugauccuggccggcaacagcagccugugcagcgugagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacaagcacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaugaacggcagcugcuucaccgugcugaccgacggccccagcaacggccaggccagcuacgagaucuucaagguggagaagggcaagaucaucaagagcaucgagcuggacgcccccaacuaccacuacgaggagugcagcugcuaccccgacaccggcaaggugaugugcgugugcagagacaacuggcacgccagcaacagacccugggugagcuucgaccagaaccugaacuaccagaucggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucagcagcagaagcggcuucgagauggugugggaccccaacggcuggaccggcaccgacagcagauucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucugggccagcggcagcagcaucagcuucugcggcgugaacagcgagaccgccagcuggagcuggcccgacggcgccgaccugcccuucaccaucgacaaguga

SEQ ID NO: 167083 - RNA, 1410 nt, Artificial Sequence
  derived and/or modified sequence opt4 from neuraminidase__InfluenzaA__ABB86916
augaaccccaaccagaagaucaucaccaucggcagcgugagccugaccaucgccaccaucugcuuccugacccagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucagcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 167084 - RNA, 1410 nt, Artificial Sequence
  derived and/or modified sequence opt4 from neuraminidase__InfluenzaA__ABB86928
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcaucgagggcaagagcugcaucaacagaugcuucuacguggagcugaucagaggcagaaaggaggagaccaaggugugguggaccagcaacagcaucgugguguucugcggcaccagcggcaccuacggcaccggcagcuggcccgacggcgccgacaucaaccugaugcccaucuga

SEQ ID NO: 167085 - RNA, 1410 nt, Artificial Sequence
  derived and/or modified sequence opt4 from neuraminidase__InfluenzaA__ABB86936
augaacaccaaccagagaaucaucaccaucggcaccgugugccugaucgugggcaucaucagccugcugcugcagaucggcaacaucgugagccuguggaucaaccacagcauccagaccgagggcaagaaccacagcgagaugugcaaccagaacgugaucaccuacgugaacaacaccugggugaacagaaccuacgugaacaucagcaacaccaacaucgccaccgugcaggacgugaccagcgugauccuggccggcaacagcagccugugccccgugagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacaagcacagcaacggcaccgugagagacagaagccccuacagaacccugaugagcugccccaccggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaugaacggcagcugcuucaccgugcugaccgacggccccagcaacggccaggccagcuacaagaucuucaagguggagaagggcaagaucaucaagagcaucgagcuggacgcccccaacuaccacuacgaggagugcagcugcuaccccgacaccggcaaggugaugugcgugugcagagacaacuggcacgccagcaacagacccuggaucuacuucgaccagaaccuggacuaccagaucggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucaacagcagaagcggcuucgagaugaucugggaccccaacggcuggaccggcaccgacagcagcuucagcaugaagcaggacauccuggccaccaccgacuggagcggcuacagcggcagcuucgugcagcaccccgagcugaccggcaugaacugcaucagacccugcuucuggguggagcugaucagaggccagcccaaggagagcaccaucugggccagcggcagcagcaucagcuucugcggcgugaacagcgagaccgccaacuggagcuggcccgacggcgccgaccugcccuucaccaucgacaaguga

SEQ ID NO: 167086 - RNA, 1410 nt, Artificial Sequence
  derived and/or modified sequence opt4 from neuraminidase__InfluenzaA__ABB86947
augaacaccaaccagagaaucaucaccaucggcaccgugugccugaucgugggcaucaucagccugcugagccagaucggcaacaucgugagccuguggaucauccacagcauccagaccggcggcaagaaccacagcgagaugugcaaccagaacgugaucaccuacgugaacaacaccugggugaacagaaccuacaucaacaucagcaacaccaacaucgccaccgugaaggacgugaccagcgugauccuggccggcaacagcagccugugccccgugagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacaagcacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaugaacggcagcugcuucaccgugcugaccgacggccccagcaacggccaggccagcuacaagaucuucaagguggagaagggcaagaucaucaagagcaucgagcuggacgcccccaacuaccacuacgaggagugcagcugcuaccccgacgccggcaaggugaugugcgugugcagagacaacuggcacgccagcaacagacccugggugagcuucgaccagaaccuggacuaccagaugggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucaacagcagaagcggcuucgagaugaucugggaccccaacggcuggaccggcaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucugggccagcggcagcagcaucagcuucugcggcgugaacagcgagaccgccagcuggagcuggcccgacggcgccgaccugcccuucaccaucgacaaguga

SEQ ID NO: 167087 - RNA, 1410 nt, Artificial Sequence
  derived and/or modified sequence opt4 from neuraminidase__InfluenzaA__ABB86957
augaacaccaaccagagaaucaucaccgugggcaccgugugccugaucgugggcaucgugagccugcugcugcagaucggcaacaucgugagccuguggaucagccacagcauccagaccggcgagaagaaccacagcgaggugugcaaccagaacaucaucaccuacgagaacaagaccugggugaaccagaccuacgugaacaucagcaacaccaacaucgccgagggccagggcgugaccagcaucaucauggccggcaacagcagccugugccccgugagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggcagcgacaacgaggccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagaucuucaagauggagaagggcaagaucaucaagagcguggagcuggaggcccccaacuaccacuacgaggagugcagcugcuaccccgacaccggcaagguggugugcgugugcagagacaacuggcacgccagcaacagacccugggugagcuucaaccagaaccuggacuaccagaucggcuacaucugcagcggcguguucggcgacaaccccagaagcaacgacggcaagggcaacugcggccccgugcccagcaacggcgccaacggcgugaagggcuucagcuucagauacggcaacggcguguggaucggcagaaccaagagcaucuucagcagaagcggcuucgagaugaucugggaccccaacggcuggaccgagaccgacagcagcuucagcaucaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucuggaccagcggcagcagcaucagcuucugcggcguggacagcgagaccgccagcuggagcuggcccgacggcgccgaccugcccuucaccaucgacaaguga

SEQ ID NO: 167088 - RNA, 1410 nt, Artificial Sequence
  derived and/or modified sequence opt4 from neuraminidase__InfluenzaA__ABB96333
augaaccccaaccagaagaucaucaccaucggcagcgugagccugaccaucgccaccaucugcuuccugaugcagaucgccauccuggugaccaccgugacccugcacuucaagcaguacgacugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgccagcagcuacgugugcagcggccuggugggcgacacccccagaaagaacgacagauacagcagcagcuacugcagaaaccccaacaacgagaagggcaaccacggcgugaagggcugggccuucgacgacggcaacgacguguggaugggcagaaccaucagcgacgagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167089 - RNA, 1410 nt, Artificial Sequence
  derived and/or modified sequence opt4 from neuraminidase__InfluenzaA__ABB96344
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcagaugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaaggugcuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgccagcagcuacgugugcagcggccuggugggcgacacccccagaaagaacgacagauacagcagcagcuacugcagaaaccccaacaacgagaagggcaaccacggcgugaagggcugggccuucgacgacggcaacgacguguggaugggcagaaccaucagcgacgagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167090 - RNA, 1410 nt, Artificial Sequence
  derived and/or modified sequence opt4 from neuraminidase__InfluenzaA__ABB96398
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaccugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgccagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167091 - RNA, 1410 nt, Artificial Sequence; identical to SEQ ID NO: 166902
  derived and/or modified sequence opt4 from neuraminidase__InfluenzaA__ABB96490

SEQ ID NO: 167092 - RNA, 1410 nt, Artificial Sequence
  derived and/or modified sequence opt4 from neuraminidase__InfluenzaA__ABB96501
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccagcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagagccagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167093 - RNA, 1410 nt, Artificial Sequence
  derived and/or modified sequence opt4 from neuraminidase__InfluenzaA__ABB96534
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167094 - RNA, 1410 nt, Artificial Sequence
  derived and/or modified sequence opt4 from neuraminidase__InfluenzaA__ABC02237
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucguggccuucugcggcaccagcggcaccuacggcaccggcagcuggcccgacggcgccgacaucaaccugaugcccaucuga

SEQ ID NO: 167095 - RNA, 1410 nt, Artificial Sequence
  derived and/or modified sequence opt4 from neuraminidase__InfluenzaA__ABC02258
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccagaucaugcccugcgagcccaccaucaucgagagaaacaucaccgagaucguguaccugaccaacaucaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccagcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaagaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcgccggcagcuggcccgacggcgccgacaucaaccugaugcccaucuga

SEQ ID NO: 167096 - RNA, 1410 nt, Artificial Sequence
  derived and/or modified sequence opt4 from neuraminidase__InfluenzaA__ABC02269
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaccagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcagcagcuacugcagaaaccccaacaacgagaagggcacccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167097 - RNA, 1413 nt, Artificial Sequence
  derived and/or modified sequence opt4 from neuraminidase__InfluenzaA__ABC02280
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcagccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167098 - RNA, 1410 nt, Artificial Sequence; identical to SEQ ID NO: 167093
  derived and/or modified sequence opt4 from neuraminidase__InfluenzaA__ABC02302

SEQ ID NO: 167099 - RNA, 1410 nt, Artificial Sequence; identical to SEQ ID NO: 167090
  derived and/or modified sequence opt4 from neuraminidase__InfluenzaA__ABC02313

SEQ ID NO: 167100 - RNA, 1410 nt, Artificial Sequence; identical to SEQ ID NO: 167095
  derived and/or modified sequence opt4 from neuraminidase__InfluenzaA__ABC02324

SEQ ID NO: 167101 - RNA, 1410 nt, Artificial Sequence
  derived and/or modified sequence opt4 from neuraminidase__InfluenzaA__ABC02335
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucaaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167102 - RNA, 1410 nt, Artificial Sequence
  derived and/or modified sequence opt4 from neuraminidase__InfluenzaA__ABC39808
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccagcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcgaccacggcgugaagggcugggccuucgacgacggcaacgacguguggaugggcagaaccaucagcgaggagagcagaagcggcuacgagaccuucaaggugaucggcggcuggagcacccccaacagcaagagccagaucaacagacaggugaucguggacagcggcaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccgacaucaaccugaugcccaucuga

SEQ ID NO: 167103 - RNA, 1410 nt, Artificial Sequence; identical to SEQ ID NO: 166902
  derived and/or modified sequence opt4 from neuraminidase__InfluenzaA__ABC40525

SEQ ID NO: 167104 - RNA, 1413 nt, Artificial Sequence
  derived and/or modified sequence opt4 from neuraminidase__InfluenzaA__ABC40536
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaucaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167105 - RNA, 1410 nt, Artificial Sequence; identical to SEQ ID NO: 167096
  derived and/or modified sequence opt4 from neuraminidase__InfluenzaA__ABC40547

SEQ ID NO: 167106 - RNA, 1410 nt, Artificial Sequence
  derived and/or modified sequence opt4 from neuraminidase__InfluenzaA__ABC40558
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagagcauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugccagaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacaucgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167107 - RNA, 1410 nt, Artificial Sequence
  derived and/or modified sequence opt4 from neuraminidase__InfluenzaA__ABC40611
augaaccccaaccagaagaucaucaccaucggcagcaucagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167108 - RNA, 1410 nt, Artificial Sequence
  derived and/or modified sequence opt4 from neuraminidase__InfluenzaA__ABC40622
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcaacgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167109 - RNA, 1410 nt, Artificial Sequence
  derived and/or modified sequence opt4 from neuraminidase__InfluenzaA__ABC40634
augaaccccaaccagaagaucaucaccaucggcagcgugagccugaccaucgccaccaucugcuuccugacccagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucgacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 167110 - RNA, 1410 nt, Artificial Sequence
  derived and/or modified sequence opt4 from neuraminidase__InfluenzaA__ABC40645
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcguggugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167111 - RNA, 1410 nt, Artificial Sequence
  derived and/or modified sequence opt4 from neuraminidase__InfluenzaA__ABC41706
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167112 - RNA, 1413 nt, Artificial Sequence
  derived and/or modified sequence opt4 from neuraminidase__InfluenzaA__ABC41717
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccgugaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 167113 - RNA, 1410 nt, Artificial Sequence
  derived and/or modified sequence opt4 from neuraminidase__InfluenzaA__ABC41728
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167114 - RNA, 1410 nt, Artificial Sequence; identical to SEQ ID NO: 167111
  derived and/or modified sequence opt4 from neuraminidase__InfluenzaA__ABC41742

SEQ ID NO: 167115 - RNA, 1410 nt, Artificial Sequence; identical to SEQ ID NO: 167111
  derived and/or modified sequence opt4 from neuraminidase__InfluenzaA__ABC41956

SEQ ID NO: 167116 - RNA, 1410 nt, Artificial Sequence; identical to SEQ ID NO: 167111
  derived and/or modified sequence opt4 from neuraminidase__InfluenzaA__ABC41967

SEQ ID NO: 167117 - RNA, 1410 nt, Artificial Sequence; identical to SEQ ID NO: 167111
  derived and/or modified sequence opt4 from neuraminidase__InfluenzaA__ABC42017

SEQ ID NO: 167118 - RNA, 1410 nt, Artificial Sequence; identical to SEQ ID NO: 167111
  derived and/or modified sequence opt4 from neuraminidase__InfluenzaA__ABC42117

SEQ ID NO: 167119 - RNA, 1410 nt, Artificial Sequence; identical to SEQ ID NO: 167111
  derived and/or modified sequence opt4 from neuraminidase__InfluenzaA__ABC42128

SEQ ID NO: 167120 - RNA, 1410 nt, Artificial Sequence; identical to SEQ ID NO: 167111
  derived and/or modified sequence opt4 from neuraminidase__InfluenzaA__ABC42139

SEQ ID NO: 167121 - RNA, 1410 nt, Artificial Sequence
  derived and/or modified sequence opt4 from neuraminidase__InfluenzaA__ABC42150
augaaccccaaccagaagaucaucaccaucggcagcgugagccugaccaucgccaccaucugcuuccugaugcagaucgccauccuggccaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcggcaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167122 - RNA, 1410 nt, Artificial Sequence; identical to SEQ ID NO: 167111
  derived and/or modified sequence opt4 from neuraminidase__InfluenzaA__ABC42161

SEQ ID NO: 167123 - RNA, 1410 nt, Artificial Sequence
  derived and/or modified sequence opt4 from neuraminidase__InfluenzaA__ABC42172
augaaccccaaccagaagaucaucaccaucggcagcgugagccugaccaucgccaccaucugcagccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167124 - RNA, 1410 nt, Artificial Sequence; identical to SEQ ID NO: 167111
  derived and/or modified sequence opt4 from neuraminidase__InfluenzaA__ABC42183

SEQ ID NO: 167125 - RNA, 1410 nt, Artificial Sequence; identical to SEQ ID NO: 167111
  derived and/or modified sequence opt4 from neuraminidase__InfluenzaA__ABC42195

SEQ ID NO: 167126 - RNA, 1410 nt, Artificial Sequence; identical to SEQ ID NO: 167111
  derived and/or modified sequence opt4 from neuraminidase__InfluenzaA__ABC42310

SEQ ID NO: 167127 - RNA, 1410 nt, Artificial Sequence; identical to SEQ ID NO: 167111
  derived and/or modified sequence opt4 from neuraminidase__InfluenzaA__ABC42321

SEQ ID NO: 167128 - RNA, 1410 nt, Artificial Sequence; identical to SEQ ID NO: 167111
  derived and/or modified sequence opt4 from neuraminidase__InfluenzaA__ABC42349

SEQ ID NO: 167129 - RNA, 1410 nt, Artificial Sequence; identical to SEQ ID NO: 167111
  derived and/or modified sequence opt4 from neuraminidase__InfluenzaA__ABC42464

SEQ ID NO: 167130 - RNA, 1410 nt, Artificial Sequence; identical to SEQ ID NO: 167111
  derived and/or modified sequence opt4 from neuraminidase__InfluenzaA__ABC42497

SEQ ID NO: 167131 - RNA, 1410 nt, Artificial Sequence; identical to SEQ ID NO: 167111
  derived and/or modified sequence opt4 from neuraminidase__InfluenzaA__ABC42508

SEQ ID NO: 167132 - RNA, 1410 nt, Artificial Sequence; identical to SEQ ID NO: 167111
  derived and/or modified sequence opt4 from neuraminidase__InfluenzaA__ABC42519

SEQ ID NO: 167133 - RNA, 1410 nt, Artificial Sequence; identical to SEQ ID NO: 167111
  derived and/or modified sequence opt4 from neuraminidase__InfluenzaA__ABC42530

SEQ ID NO: 167134 - RNA, 1410 nt, Artificial Sequence; identical to SEQ ID NO: 167111
  derived and/or modified sequence opt4 from neuraminidase__InfluenzaA__ABC42577

SEQ ID NO: 167135 - RNA, 1410 nt, Artificial Sequence; identical to SEQ ID NO: 167111
  derived and/or modified sequence opt4 from neuraminidase__InfluenzaA__ABC42588

SEQ ID NO: 167136 - RNA, 1410 nt, Artificial Sequence; identical to SEQ ID NO: 166847
  derived and/or modified sequence opt4 from neuraminidase__InfluenzaA__ABC42599

SEQ ID NO: 167137 - RNA, 1410 nt, Artificial Sequence; identical to SEQ ID NO: 166847
  derived and/or modified sequence opt4 from neuraminidase__InfluenzaA__ABC42610

SEQ ID NO: 167138 - RNA, 1410 nt, Artificial Sequence; identical to SEQ ID NO: 166847
  derived and/or modified sequence opt4 from neuraminidase__InfluenzaA__ABC42621

SEQ ID NO: 167139 - RNA, 1410 nt, Artificial Sequence; identical to SEQ ID NO: 166847
  derived and/or modified sequence opt4 from neuraminidase__InfluenzaA__ABC42632

SEQ ID NO: 167140 - RNA, 1410 nt, Artificial Sequence; identical to SEQ ID NO: 166847
  derived and/or modified sequence opt4 from neuraminidase__InfluenzaA__ABC42643

SEQ ID NO: 167141 - RNA, 1410 nt, Artificial Sequence; identical to SEQ ID NO: 166847
  derived and/or modified sequence opt4 from neuraminidase__InfluenzaA__ABC42654

SEQ ID NO: 167142 - RNA, 1410 nt, Artificial Sequence; identical to SEQ ID NO: 166847
  derived and/or modified sequence opt4 from neuraminidase__InfluenzaA__ABC42665

SEQ ID NO: 167143 - RNA, 1410 nt, Artificial Sequence; identical to SEQ ID NO: 166847
  derived and/or modified sequence opt4 from neuraminidase__InfluenzaA__ABC42676

SEQ ID NO: 167144 - RNA, 1410 nt, Artificial Sequence; identical to SEQ ID NO: 166847
  derived and/or modified sequence opt4 from neuraminidase__InfluenzaA__ABC42687

SEQ ID NO: 167145 - RNA, 1410 nt, Artificial Sequence; identical to SEQ ID NO: 166847
  derived and/or modified sequence opt4 from neuraminidase__InfluenzaA__ABC42698

SEQ ID NO: 167146 - RNA, 1410 nt, Artificial Sequence; identical to SEQ ID NO: 166847
  derived and/or modified sequence opt4 from neuraminidase__InfluenzaA__ABC42709

SEQ ID NO: 167147 - RNA, 1410 nt, Artificial Sequence; identical to SEQ ID NO: 166847
  derived and/or modified sequence opt4 from neuraminidase__InfluenzaA__ABC42720

SEQ ID NO: 167148 - RNA, 1410 nt, Artificial Sequence
  derived and/or modified sequence opt4 from neuraminidase__InfluenzaA__ABC42742
augaaccccaaccagaagaucaucaccaucggcagcgugagccugaccaucagcaccaucugcuucuucaugcagaucgccauccugaugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaagaaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167149 - RNA, 1410 nt, Artificial Sequence; identical to SEQ ID NO: 166847
  derived and/or modified sequence opt4 from neuraminidase__InfluenzaA__ABC42764

SEQ ID NO: 167150 - RNA, 1410 nt, Artificial Sequence; identical to SEQ ID NO: 166847
  derived and/or modified sequence opt4 from neuraminidase__InfluenzaA__ABC42775

SEQ ID NO: 167151 - RNA, 1410 nt, Artificial Sequence; identical to SEQ ID NO: 166847
  derived and/or modified sequence opt4 from neuraminidase__InfluenzaA__ABC42786

SEQ ID NO: 167152 - RNA, 1410 nt, Artificial Sequence; identical to SEQ ID NO: 166847
  derived and/or modified sequence opt4 from neuraminidase__InfluenzaA__ABC42797

SEQ ID NO: 167153 - RNA, 1410 nt, Artificial Sequence; identical to SEQ ID NO: 166847
  derived and/or modified sequence opt4 from neuraminidase__InfluenzaA__ABC42808

SEQ ID NO: 167154 - RNA, 1410 nt, Artificial Sequence; identical to SEQ ID NO: 166847
  derived and/or modified sequence opt4 from neuraminidase__InfluenzaA__ABC42819

SEQ ID NO: 167155 - RNA, 1410 nt, Artificial Sequence
  derived and/or modified sequence opt4 from neuraminidase__InfluenzaA__ABC42841
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcagaaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167156 - RNA, 1410 nt, Artificial Sequence; identical to SEQ ID NO: 166847
  derived and/or modified sequence opt4 from neuraminidase__InfluenzaA__ABC42852

SEQ ID NO: 167157 - RNA, 1410 nt, Artificial Sequence; identical to SEQ ID NO: 166847
  derived and/or modified sequence opt4 from neuraminidase__InfluenzaA__ABC42863

SEQ ID NO: 167158 - RNA, 1410 nt, Artificial Sequence; identical to SEQ ID NO: 166686
  derived and/or modified sequence opt4 from neuraminidase__InfluenzaA__ABC42874

SEQ ID NO: 167159 - RNA, 1410 nt, Artificial Sequence; identical to SEQ ID NO: 166686
  derived and/or modified sequence opt4 from neuraminidase__InfluenzaA__ABC42885

SEQ ID NO: 167160 - RNA, 1410 nt, Artificial Sequence; identical to SEQ ID NO: 166686
  derived and/or modified sequence opt4 from neuraminidase__InfluenzaA__ABC42896

SEQ ID NO: 167161 - RNA, 1410 nt, Artificial Sequence; identical to SEQ ID NO: 167111
  derived and/or modified sequence opt4 from neuraminidase__InfluenzaA__ABC42914

SEQ ID NO: 167162 - RNA, 1410 nt, Artificial Sequence; identical to SEQ ID NO: 167111
  derived and/or modified sequence opt4 from neuraminidase__InfluenzaA__ABC42932

SEQ ID NO: 167163 - RNA, 1410 nt, Artificial Sequence
  derived and/or modified sequence opt4 from neuraminidase__InfluenzaA__ABC42943
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggugggcuacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167164 - RNA, 1410 nt, Artificial Sequence; identical to SEQ ID NO: 167111
  derived and/or modified sequence opt4 from neuraminidase__InfluenzaA__ABC42954

SEQ ID NO: 167165 - RNA, 1410 nt, Artificial Sequence; identical to SEQ ID NO: 167111
  derived and/or modified sequence opt4 from neuraminidase__InfluenzaA__ABC42965

SEQ ID NO: 167166 - RNA, 1410 nt, Artificial Sequence
  derived and/or modified sequence opt4 from neuraminidase__InfluenzaA__ABC42976
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggccaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167167 - RNA, 1410 nt, Artificial Sequence; identical to SEQ ID NO: 167111
  derived and/or modified sequence opt4 from neuraminidase__InfluenzaA__ABC42987

SEQ ID NO: 167168 - RNA, 1410 nt, Artificial Sequence; identical to SEQ ID NO: 167111
  derived and/or modified sequence opt4 from neuraminidase__InfluenzaA__ABC42998

SEQ ID NO: 167169 - RNA, 1410 nt, Artificial Sequence; identical to SEQ ID NO: 167111
  derived and/or modified sequence opt4 from neuraminidase__InfluenzaA__ABC43009

SEQ ID NO: 167170 - RNA, 1410 nt, Artificial Sequence; identical to SEQ ID NO: 167111
  derived and/or modified sequence opt4 from neuraminidase__InfluenzaA__ABC43020

SEQ ID NO: 167171 - RNA, 1410 nt, Artificial Sequence
  derived and/or modified sequence opt4 from neuraminidase__InfluenzaA__ABC43042
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugagcaucuga

SEQ ID NO: 167172 - RNA, 1410 nt, Artificial Sequence; identical to SEQ ID NO: 167111
  derived and/or modified sequence opt4 from neuraminidase__InfluenzaA__ABC43053

SEQ ID NO: 167173 - RNA, 1410 nt, Artificial Sequence
  derived and/or modified sequence opt4 from neuraminidase__InfluenzaA__ABC43064
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggagaagaccgaggugugguggaccagcaacagcaucgugguguucugcggcaccagcggcaccuacggcaccggcagcuggcccgacggcgccgacaucaaccugaugcccaucuga

SEQ ID NO: 167174 - RNA, 1410 nt, Artificial Sequence; identical to SEQ ID NO: 167111
  derived and/or modified sequence opt4 from neuraminidase__InfluenzaA__ABC43075

SEQ ID NO: 167175 - RNA, 1410 nt, Artificial Sequence
  derived and/or modified sequence opt4 from neuraminidase__InfluenzaA__ABC43086
augaaccccaaccagaagaucaucaccaucggcagcgugagccugaucaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167176 - RNA, 1410 nt, Artificial Sequence; identical to SEQ ID NO: 167111
  derived and/or modified sequence opt4 from neuraminidase__InfluenzaA__ABC43097

SEQ ID NO: 167177 - RNA, 1410 nt, Artificial Sequence; identical to SEQ ID NO: 167111
  derived and/or modified sequence opt4 from neuraminidase__InfluenzaA__ABC43108

SEQ ID NO: 167178 - RNA, 1410 nt, Artificial Sequence; identical to SEQ ID NO: 167111
  derived and/or modified sequence opt4 from neuraminidase__InfluenzaA__ABC43119

SEQ ID NO: 167179 - RNA, 1410 nt, Artificial Sequence; identical to SEQ ID NO: 166847
  derived and/or modified sequence opt4 from neuraminidase__InfluenzaA__ABC43130

SEQ ID NO: 167180 - RNA, 1410 nt, Artificial Sequence; identical to SEQ ID NO: 166847
  derived and/or modified sequence opt4 from neuraminidase__InfluenzaA__ABC43141

SEQ ID NO: 167181 - RNA, 1410 nt, Artificial Sequence; identical to SEQ ID NO: 166847
  derived and/or modified sequence opt4 from neuraminidase__InfluenzaA__ABC43152

SEQ ID NO: 167182 - RNA, 1410 nt, Artificial Sequence; identical to SEQ ID NO: 166847
  derived and/or modified sequence opt4 from neuraminidase__InfluenzaA__ABC43163

SEQ ID NO: 167183 - RNA, 1410 nt, Artificial Sequence; identical to SEQ ID NO: 166847
  derived and/or modified sequence opt4 from neuraminidase__InfluenzaA__ABC43174

SEQ ID NO: 167184 - RNA, 1410 nt, Artificial Sequence
  derived and/or modified sequence opt4 from neuraminidase__InfluenzaA__ABC43185
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccagaauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167185 - RNA, 1410 nt, Artificial Sequence; identical to SEQ ID NO: 166847
  derived and/or modified sequence opt4 from neuraminidase__InfluenzaA__ABC43478

SEQ ID NO: 167186 - RNA, 1410 nt, Artificial Sequence; identical to SEQ ID NO: 166847
  derived and/or modified sequence opt4 from neuraminidase__InfluenzaA__ABC43489

SEQ ID NO: 167187 - RNA, 1410 nt, Artificial Sequence; identical to SEQ ID NO: 166847
  derived and/or modified sequence opt4 from neuraminidase__InfluenzaA__ABC43500

SEQ ID NO: 167188 - RNA, 1410 nt, Artificial Sequence
  derived and/or modified sequence opt4 from neuraminidase__InfluenzaA__ABC43511
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagaccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167189 - RNA, 1410 nt, Artificial Sequence; identical to SEQ ID NO: 166847
  derived and/or modified sequence opt4 from neuraminidase__InfluenzaA__ABC43522

SEQ ID NO: 167190 - RNA, 1410 nt, Artificial Sequence; identical to SEQ ID NO: 166847
  derived and/or modified sequence opt4 from neuraminidase__InfluenzaA__ABC43533

SEQ ID NO: 167191 - RNA, 1410 nt, Artificial Sequence; identical to SEQ ID NO: 166847
  derived and/or modified sequence opt4 from neuraminidase__InfluenzaA__ABC43544

SEQ ID NO: 167192 - RNA, 1410 nt, Artificial Sequence; identical to SEQ ID NO: 166847
  derived and/or modified sequence opt4 from neuraminidase__InfluenzaA__ABC43555

SEQ ID NO: 167193 - RNA, 1410 nt, Artificial Sequence; identical to SEQ ID NO: 167090
  derived and/or modified sequence opt4 from neuraminidase__InfluenzaA__ABC46557

SEQ ID NO: 167194 - RNA, 1410 nt, Artificial Sequence
  derived and/or modified sequence opt4 from neuraminidase__InfluenzaA__ABC46579
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167195 - RNA, 1410 nt, Artificial Sequence; identical to SEQ ID NO: 167034
  derived and/or modified sequence opt4 from neuraminidase__InfluenzaA__ABC50170

SEQ ID NO: 167196 - RNA, 1410 nt, Artificial Sequence; identical to SEQ ID NO: 167034
  derived and/or modified sequence opt4 from neuraminidase__InfluenzaA__ABC50181

SEQ ID NO: 167197 - RNA, 1410 nt, Artificial Sequence; identical to SEQ ID NO: 167034
  derived and/or modified sequence opt4 from neuraminidase__InfluenzaA__ABC50192

SEQ ID NO: 167198 - RNA, 1410 nt, Artificial Sequence; identical to SEQ ID NO: 166686
  derived and/or modified sequence opt4 from neuraminidase__InfluenzaA__ABC50203

SEQ ID NO: 167199 - RNA, 1410 nt, Artificial Sequence
  derived and/or modified sequence opt4 from neuraminidase__InfluenzaA__ABC50214
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucaucgacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaaccccaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167200 - RNA, 1410 nt, Artificial Sequence; identical to SEQ ID NO: 166686
  derived and/or modified sequence opt4 from neuraminidase__InfluenzaA__ABC50225

SEQ ID NO: 167201 - RNA, 1410 nt, Artificial Sequence; identical to SEQ ID NO: 166686
  derived and/or modified sequence opt4 from neuraminidase__InfluenzaA__ABC50247

SEQ ID NO: 167202 - RNA, 1410 nt, Artificial Sequence
  derived and/or modified sequence opt4 from neuraminidase__InfluenzaA__ABC50258
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucaucgacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcaucgagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167203 - RNA, 1410 nt, Artificial Sequence; identical to SEQ ID NO: 166686
  derived and/or modified sequence opt4 from neuraminidase__InfluenzaA__ABC50280

SEQ ID NO: 167204 - RNA, 1410 nt, Artificial Sequence; identical to SEQ ID NO: 166686
  derived and/or modified sequence opt4 from neuraminidase__InfluenzaA__ABC50291

SEQ ID NO: 167205 - RNA, 1410 nt, Artificial Sequence
  derived and/or modified sequence opt4 from neuraminidase__InfluenzaA__ABC50302
augaaccccaaccagaagaucaucaccaucggcagcgugagccugaccaucgccaccaucugcuuccugaugcagaucgccauccugaucaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167206 - RNA, 1410 nt, Artificial Sequence
  derived and/or modified sequence opt4 from neuraminidase__InfluenzaA__ABC50313
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167207 - RNA, 1410 nt, Artificial Sequence; identical to SEQ ID NO: 166686
  derived and/or modified sequence opt4 from neuraminidase__InfluenzaA__ABC50324

SEQ ID NO: 167208 - RNA, 1410 nt, Artificial Sequence; identical to SEQ ID NO: 166674
  derived and/or modified sequence opt4 from neuraminidase__InfluenzaA__ABC50335

SEQ ID NO: 167209 - RNA, 1410 nt, Artificial Sequence
  derived and/or modified sequence opt4 from neuraminidase__InfluenzaA__ABC50346
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucaucgacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167210 - RNA, 1410 nt, Artificial Sequence; identical to SEQ ID NO: 166686
  derived and/or modified sequence opt4 from neuraminidase__InfluenzaA__ABC50357

SEQ ID NO: 167211 - RNA, 1410 nt, Artificial Sequence; identical to SEQ ID NO: 166686
  derived and/or modified sequence opt4 from neuraminidase__InfluenzaA__ABC50368

SEQ ID NO: 167212 - RNA, 1410 nt, Artificial Sequence; identical to SEQ ID NO: 166686
  derived and/or modified sequence opt4 from neuraminidase__InfluenzaA__ABC50379

SEQ ID NO: 167213 - RNA, 1410 nt, Artificial Sequence; identical to SEQ ID NO: 166686
  derived and/or modified sequence opt4 from neuraminidase__InfluenzaA__ABC50390

SEQ ID NO: 167214 - RNA, 1410 nt, Artificial Sequence
  derived and/or modified sequence opt4 from neuraminidase__InfluenzaA__ABC50412
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167215 - RNA, 1410 nt, Artificial Sequence; identical to SEQ ID NO: 167214
  derived and/or modified sequence opt4 from neuraminidase__InfluenzaA__ABC50423

SEQ ID NO: 167216 - RNA, 1410 nt, Artificial Sequence; identical to SEQ ID NO: 166799
  derived and/or modified sequence opt4 from neuraminidase__InfluenzaA__ABC54671

SEQ ID NO: 167217 - RNA, 1410 nt, Artificial Sequence; identical to SEQ ID NO: 166931
  derived and/or modified sequence opt4 from neuraminidase__InfluenzaA__ABC54682

SEQ ID NO: 167218 - RNA, 1410 nt, Artificial Sequence; identical to SEQ ID NO: 167111
  derived and/or modified sequence opt4 from neuraminidase__InfluenzaA__ABC67322

SEQ ID NO: 167219 - RNA, 1410 nt, Artificial Sequence; identical to SEQ ID NO: 166686
  derived and/or modified sequence opt4 from neuraminidase__InfluenzaA__ABC67474

SEQ ID NO: 167220 - RNA, 1410 nt, Artificial Sequence; identical to SEQ ID NO: 167209
  derived and/or modified sequence opt4 from neuraminidase__InfluenzaA__ABC67546

SEQ ID NO: 167221 - RNA, 1410 nt, Artificial Sequence
  derived and/or modified sequence opt4 from neuraminidase__InfluenzaA__ABC67557
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167222 - RNA, 1410 nt, Artificial Sequence
  derived and/or modified sequence opt4 from neuraminidase__InfluenzaA__ABC67568
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccaacaucaaccugaugcccaucuga

SEQ ID NO: 167223 - RNA, 1410 nt, Artificial Sequence
  derived and/or modified sequence opt4 from neuraminidase__InfluenzaA__ABC67579
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167224 - RNA, 1410 nt, Artificial Sequence; identical to SEQ ID NO: 166847
  derived and/or modified sequence opt4 from neuraminidase__InfluenzaA__ABC67590

SEQ ID NO: 167225 - RNA, 1410 nt, Artificial Sequence; identical to SEQ ID NO: 166847
  derived and/or modified sequence opt4 from neuraminidase__InfluenzaA__ABC67601

SEQ ID NO: 167226 - RNA, 1410 nt, Artificial Sequence; identical to SEQ ID NO: 166686
  derived and/or modified sequence opt4 from neuraminidase__InfluenzaA__ABC67612

SEQ ID NO: 167227 - RNA, 1410 nt, Artificial Sequence; identical to SEQ ID NO: 166686
  derived and/or modified sequence opt4 from neuraminidase__InfluenzaA__ABC67623

SEQ ID NO: 167228 - RNA, 1410 nt, Artificial Sequence
  derived and/or modified sequence opt4 from neuraminidase__InfluenzaA__ABC67634
augaaccccaaccagaagaucaucaccaucggcagcgugagccugaccaucgccaccaucugcuuccugaugcagaucgccauccuggugaccaccgugacccugcacuucaagcaguacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167229 - RNA, 1410 nt, Artificial Sequence; identical to SEQ ID NO: 166686
  derived and/or modified sequence opt4 from neuraminidase__InfluenzaA__ABC67645

SEQ ID NO: 167230 - RNA, 1410 nt, Artificial Sequence; identical to SEQ ID NO: 166686
  derived and/or modified sequence opt4 from neuraminidase__InfluenzaA__ABC67656

SEQ ID NO: 167231 - RNA, 1410 nt, Artificial Sequence
  derived and/or modified sequence opt4 from neuraminidase__InfluenzaA__ABC67700
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaacagcaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167232 - RNA, 1410 nt, Artificial Sequence
  derived and/or modified sequence opt4 from neuraminidase__InfluenzaA__ABC67711
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167233 - RNA, 1410 nt, Artificial Sequence
  derived and/or modified sequence opt4 from neuraminidase__InfluenzaA__ABC67736
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcguggccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167234 - RNA, 1410 nt, Artificial Sequence
  derived and/or modified sequence opt4 from neuraminidase__InfluenzaA__ABC67809
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167235 - RNA, 1410 nt, Artificial Sequence; identical to SEQ ID NO: 167111
  derived and/or modified sequence opt4 from neuraminidase__InfluenzaA__ABC67820

SEQ ID NO: 167236 - RNA, 1410 nt, Artificial Sequence; identical to SEQ ID NO: 167090
  derived and/or modified sequence opt4 from neuraminidase__InfluenzaA__ABC67842

SEQ ID NO: 167237 - RNA, 1410 nt, Artificial Sequence; identical to SEQ ID NO: 166686
  derived and/or modified sequence opt4 from neuraminidase__InfluenzaA__ABC67853

SEQ ID NO: 167238 - RNA, 1410 nt, Artificial Sequence; identical to SEQ ID NO: 167090
  derived and/or modified sequence opt4 from neuraminidase__InfluenzaA__ABC67864

SEQ ID NO: 167239 - RNA, 1410 nt, Artificial Sequence; identical to SEQ ID NO: 167209
  derived and/or modified sequence opt4 from neuraminidase__InfluenzaA__ABC67886

SEQ ID NO: 167240 - RNA, 1410 nt, Artificial Sequence; identical to SEQ ID NO: 166686
  derived and/or modified sequence opt4 from neuraminidase__InfluenzaA__ABC67897

SEQ ID NO: 167241 - RNA, 1410 nt, Artificial Sequence; identical to SEQ ID NO: 166686
  derived and/or modified sequence opt4 from neuraminidase__InfluenzaA__ABC67970

SEQ ID NO: 167242 - RNA, 1410 nt, Artificial Sequence
  derived and/or modified sequence opt4 from neuraminidase__InfluenzaA__ABC67981
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuacccccaguaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167243 - RNA, 1410 nt, Artificial Sequence
  derived and/or modified sequence opt4 from neuraminidase__InfluenzaA__ABC67992
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacaacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaucgaggugugguggaccagcaacagcaucgugguguucugcggcaccagcggcaccuacggcaccggcagcuggcccgacggcgccgacaucaaccugaugcccaucuga

SEQ ID NO: 167244 - RNA, 1410 nt, Artificial Sequence; identical to SEQ ID NO: 167209
  derived and/or modified sequence opt4 from neuraminidase__InfluenzaA__ABC68003

SEQ ID NO: 167245 - RNA, 1410 nt, Artificial Sequence
  derived and/or modified sequence opt4 from neuraminidase__InfluenzaA__ABC68052
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaucgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167246 - RNA, 1410 nt, Artificial Sequence; identical to SEQ ID NO: 166686
  derived and/or modified sequence opt4 from neuraminidase__InfluenzaA__ABC68063

SEQ ID NO: 167247 - RNA, 1410 nt, Artificial Sequence; identical to SEQ ID NO: 166686
  derived and/or modified sequence opt4 from neuraminidase__InfluenzaA__ABC68074

SEQ ID NO: 167248 - RNA, 1410 nt, Artificial Sequence; identical to SEQ ID NO: 167232
  derived and/or modified sequence opt4 from neuraminidase__InfluenzaA__ABC68085

SEQ ID NO: 167249 - RNA, 1410 nt, Artificial Sequence
  derived and/or modified sequence opt4 from neuraminidase__InfluenzaA__ABC68096
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcacaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167250 - RNA, 1410 nt, Artificial Sequence
  derived and/or modified sequence opt4 from neuraminidase__InfluenzaA__ABC68225
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167251 - RNA, 1410 nt, Artificial Sequence; identical to SEQ ID NO: 167039
  derived and/or modified sequence opt4 from neuraminidase__InfluenzaA__ABC68236

SEQ ID NO: 167252 - RNA, 1350 nt, Artificial Sequence
  derived and/or modified sequence opt4 from neuraminidase__InfluenzaA__ABC72646
augaaccccaacaagaagaucaucaccaucggcagcaucugcauggugaccggcauggugagccugaugcugcagaucggcaaccugaucagcaucugggugagccacagcauccacaccggcaaccagcagaaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcagccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggacaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacacccccagacccaacgacggcaccggcagcugcggccccgugagcagcaacggcaccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167253 - RNA, 1410 nt, Artificial Sequence; identical to SEQ ID NO: 166615
  derived and/or modified sequence opt4 from neuraminidase__InfluenzaA__ABC84392

SEQ ID NO: 167254 - RNA, 1410 nt, Artificial Sequence; identical to SEQ ID NO: 167029
  derived and/or modified sequence opt4 from neuraminidase__InfluenzaA__ABC84403

SEQ ID NO: 167255 - RNA, 1410 nt, Artificial Sequence; identical to SEQ ID NO: 167034
  derived and/or modified sequence opt4 from neuraminidase__InfluenzaA__ABC84414

SEQ ID NO: 167256 - RNA, 1410 nt, Artificial Sequence
  derived and/or modified sequence opt4 from neuraminidase__InfluenzaA__ABC84425
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagaacugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167257 - RNA, 1410 nt, Artificial Sequence; identical to SEQ ID NO: 166847
  derived and/or modified sequence opt4 from neuraminidase__InfluenzaA__ABC84436

SEQ ID NO: 167258 - RNA, 1410 nt, Artificial Sequence
  derived and/or modified sequence opt4 from neuraminidase__InfluenzaA__ABC84447
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucgugcaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167259 - RNA, 1410 nt, Artificial Sequence; identical to SEQ ID NO: 167234
  derived and/or modified sequence opt4 from neuraminidase__InfluenzaA__ABC84501

SEQ ID NO: 167260 - RNA, 1410 nt, Artificial Sequence; identical to SEQ ID NO: 167234
  derived and/or modified sequence opt4 from neuraminidase__InfluenzaA__ABC84512

SEQ ID NO: 167261 - RNA, 1410 nt, Artificial Sequence
  derived and/or modified sequence opt4 from neuraminidase__InfluenzaA__ABC84523
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacuggccgacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167262 - RNA, 1410 nt, Artificial Sequence
  derived and/or modified sequence opt4 from neuraminidase__InfluenzaA__ABC84545
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagcgccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggaccacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167263 - RNA, 1410 nt, Artificial Sequence; identical to SEQ ID NO: 167250
  derived and/or modified sequence opt4 from neuraminidase__InfluenzaA__ABC84574

SEQ ID NO: 167264 - RNA, 1410 nt, Artificial Sequence; identical to SEQ ID NO: 167250
  derived and/or modified sequence opt4 from neuraminidase__InfluenzaA__ABC85757

SEQ ID NO: 167265 - RNA, 1410 nt, Artificial Sequence; identical to SEQ ID NO: 167261
  derived and/or modified sequence opt4 from neuraminidase__InfluenzaA__ABC85768

SEQ ID NO: 167266 - RNA, 1410 nt, Artificial Sequence; identical to SEQ ID NO: 167250
  derived and/or modified sequence opt4 from neuraminidase__InfluenzaA__ABC85779

SEQ ID NO: 167267 - RNA, 1410 nt, Artificial Sequence; identical to SEQ ID NO: 167250
  derived and/or modified sequence opt4 from neuraminidase__InfluenzaA__ABC85790

SEQ ID NO: 167268 - RNA, 1410 nt, Artificial Sequence; identical to SEQ ID NO: 167234
  derived and/or modified sequence opt4 from neuraminidase__InfluenzaA__ABC85801

SEQ ID NO: 167269 - RNA, 1410 nt, Artificial Sequence; identical to SEQ ID NO: 167234
  derived and/or modified sequence opt4 from neuraminidase__InfluenzaA__ABC85812

SEQ ID NO: 167270 - RNA, 1410 nt, Artificial Sequence; identical to SEQ ID NO: 167261
  derived and/or modified sequence opt4 from neuraminidase__InfluenzaA__ABC85823

SEQ ID NO: 167271 - RNA, 1410 nt, Artificial Sequence; identical to SEQ ID NO: 167233
  derived and/or modified sequence opt4 from neuraminidase__InfluenzaA__ABC85834

SEQ ID NO: 167272 - RNA, 1410 nt, Artificial Sequence; identical to SEQ ID NO: 167234
  derived and/or modified sequence opt4 from neuraminidase__InfluenzaA__ABC85845

SEQ ID NO: 167273 - RNA, 1410 nt, Artificial Sequence; identical to SEQ ID NO: 167261
  derived and/or modified sequence opt4 from neuraminidase__InfluenzaA__ABC85856

SEQ ID NO: 167274 - RNA, 1410 nt, Artificial Sequence; identical to SEQ ID NO: 167233
  derived and/or modified sequence opt4 from neuraminidase__InfluenzaA__ABC85867

SEQ ID NO: 167275 - RNA, 1410 nt, Artificial Sequence; identical to SEQ ID NO: 167232
  derived and/or modified sequence opt4 from neuraminidase__InfluenzaA__ABC85900

SEQ ID NO: 167276 - RNA, 1410 nt, Artificial Sequence
  derived and/or modified sequence opt4 from neuraminidase__InfluenzaA__ABC85911
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacauguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167277 - RNA, 1410 nt, Artificial Sequence
  derived and/or modified sequence opt4 from neuraminidase__InfluenzaA__ABC85922
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaccaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgacagcgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167278 - RNA, 1410 nt, Artificial Sequence; identical to SEQ ID NO: 166686
  derived and/or modified sequence opt4 from neuraminidase__InfluenzaA__ABC85933

SEQ ID NO: 167279 - RNA, 1410 nt, Artificial Sequence
  derived and/or modified sequence opt4 from neuraminidase__InfluenzaA__ABC85955
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaacagaaugcccaucuga

SEQ ID NO: 167280 - RNA, 1410 nt, Artificial Sequence; identical to SEQ ID NO: 166686
  derived and/or modified sequence opt4 from neuraminidase__InfluenzaA__ABC85966

SEQ ID NO: 167281 - RNA, 1410 nt, Artificial Sequence; identical to SEQ ID NO: 166686
  derived and/or modified sequence opt4 from neuraminidase__InfluenzaA__ABC85977

SEQ ID NO: 167282 - RNA, 1410 nt, Artificial Sequence
  derived and/or modified sequence opt4 from neuraminidase__InfluenzaA__ABC85988
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaagggcaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167283 - RNA, 1410 nt, Artificial Sequence; identical to SEQ ID NO: 166847
  derived and/or modified sequence opt4 from neuraminidase__InfluenzaA__ABC85999

SEQ ID NO: 167284 - RNA, 1410 nt, Artificial Sequence; identical to SEQ ID NO: 166847
  derived and/or modified sequence opt4 from neuraminidase__InfluenzaA__ABC86010

SEQ ID NO: 167285 - RNA, 1410 nt, Artificial Sequence
  derived and/or modified sequence opt4 from neuraminidase__InfluenzaA__ABC86021
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 167286 - RNA, 1410 nt, Artificial Sequence; identical to SEQ ID NO: 167111
  derived and/or modified sequence opt4 from neuraminidase__InfluenzaA__ABC86127

SEQ ID NO: 167287 - RNA, 1410 nt, Artificial Sequence; identical to SEQ ID NO: 167194
  derived and/or modified sequence opt4 from neuraminidase__InfluenzaA__ABC86140

SEQ ID NO: 167288 - RNA, 1410 nt, Artificial Sequence; identical to SEQ ID NO: 167004
  derived and/or modified sequence opt4 from neuraminidase__InfluenzaA__ABC86151

SEQ ID NO: 167289 - RNA, 1413 nt, Artificial Sequence
  derived and/or modified sequence opt4 from neuraminidase__InfluenzaA__ABC86240
augaaccccaaccagaagaucaucaccaucggcagcaucagcguggccaucggcaucaucagccugauccugcagaucggcaacaucaucagcaucugggccagccacagcauccagaccggcagccagaacuacaccggcaucugcaaccagaagaucaucaccuacgagaacagaaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuucagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 167290 - RNA, 1410 nt, Artificial Sequence
  derived and/or modified sequence opt4 from neuraminidase__InfluenzaA__ABC97377
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagcgccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167291 - RNA, 1410 nt, Artificial Sequence; identical to SEQ ID NO: 166657
  derived and/or modified sequence opt4 from neuraminidase__InfluenzaA__ABD15452

SEQ ID NO: 167292 - RNA, 1410 nt, Artificial Sequence; identical to SEQ ID NO: 166745
  derived and/or modified sequence opt4 from neuraminidase__InfluenzaA__ABD15463

SEQ ID NO: 167293 - RNA, 1410 nt, Artificial Sequence; identical to SEQ ID NO: 166665
  derived and/or modified sequence opt4 from neuraminidase__InfluenzaA__ABD15474

SEQ ID NO: 167294 - RNA, 1410 nt, Artificial Sequence
  derived and/or modified sequence opt4 from neuraminidase__InfluenzaA__ABD15485
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccaacaucaaccugaugcccaucuga

SEQ ID NO: 167295 - RNA, 1410 nt, Artificial Sequence; identical to SEQ ID NO: 166745
  derived and/or modified sequence opt4 from neuraminidase__InfluenzaA__ABD15496

SEQ ID NO: 167296 - RNA, 1410 nt, Artificial Sequence; identical to SEQ ID NO: 166665
  derived and/or modified sequence opt4 from neuraminidase__InfluenzaA__ABD15507

SEQ ID NO: 167297 - RNA, 1413 nt, Artificial Sequence
  derived and/or modified sequence opt4 from neuraminidase__InfluenzaA__ABD15518
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcggcgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 167298 - RNA, 1410 nt, Artificial Sequence; identical to SEQ ID NO: 166847
  derived and/or modified sequence opt4 from neuraminidase__InfluenzaA__ABD15529

SEQ ID NO: 167299 - RNA, 1410 nt, Artificial Sequence; identical to SEQ ID NO: 167034
  derived and/or modified sequence opt4 from neuraminidase__InfluenzaA__ABD15551

SEQ ID NO: 167300 - RNA, 1410 nt, Artificial Sequence
  derived and/or modified sequence opt4 from neuraminidase__InfluenzaA__ABD15562
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccaucgugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167301 - RNA, 1410 nt, Artificial Sequence
  derived and/or modified sequence opt4 from neuraminidase__InfluenzaA__ABD15573
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcauggccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167302 - RNA, 1410 nt, Artificial Sequence
  derived and/or modified sequence opt4 from neuraminidase__InfluenzaA__ABD15584
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacgagaacgacguguggaugggcagaaccaucagcgagaaguucagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucaucguguucugcggcaccagcggcaccuacggcaccggcagcuggcccgacggcgccgacaucaaccugaugcccaucuga

SEQ ID NO: 167303 - RNA, 1410 nt, Artificial Sequence; identical to SEQ ID NO: 167034
  derived and/or modified sequence opt4 from neuraminidase__InfluenzaA__ABD15595

SEQ ID NO: 167304 - RNA, 1410 nt, Artificial Sequence; identical to SEQ ID NO: 167034
  derived and/or modified sequence opt4 from neuraminidase__InfluenzaA__ABD15606

SEQ ID NO: 167305 - RNA, 1410 nt, Artificial Sequence; identical to SEQ ID NO: 167034
  derived and/or modified sequence opt4 from neuraminidase__InfluenzaA__ABD15617

SEQ ID NO: 167306 - RNA, 1410 nt, Artificial Sequence; identical to SEQ ID NO: 167093
  derived and/or modified sequence opt4 from neuraminidase__InfluenzaA__ABD15639

SEQ ID NO: 167307 - RNA, 1410 nt, Artificial Sequence; identical to SEQ ID NO: 167250
  derived and/or modified sequence opt4 from neuraminidase__InfluenzaA__ABD15650

SEQ ID NO: 167308 - RNA, 1410 nt, Artificial Sequence; identical to SEQ ID NO: 166773
  derived and/or modified sequence opt4 from neuraminidase__InfluenzaA__ABD15661

SEQ ID NO: 167309 - RNA, 1410 nt, Artificial Sequence; identical to SEQ ID NO: 167250
  derived and/or modified sequence opt4 from neuraminidase__InfluenzaA__ABD15683

SEQ ID NO: 167310 - RNA, 1410 nt, Artificial Sequence; identical to SEQ ID NO: 166773
  derived and/or modified sequence opt4 from neuraminidase__InfluenzaA__ABD15694

SEQ ID NO: 167311 - RNA, 1410 nt, Artificial Sequence; identical to SEQ ID NO: 167250
  derived and/or modified sequence opt4 from neuraminidase__InfluenzaA__ABD15705

SEQ ID NO: 167312 - RNA, 1410 nt, Artificial Sequence; identical to SEQ ID NO: 167250
  derived and/or modified sequence opt4 from neuraminidase__InfluenzaA__ABD15727

SEQ ID NO: 167313 - RNA, 1410 nt, Artificial Sequence
  derived and/or modified sequence opt4 from neuraminidase__InfluenzaA__ABD15749
augaaccccaaccagaagaucaucaccaucggcagcgugagccugaccaucgccaccaucugcuuccugaugcagaucgccgugcuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167314 - RNA, 1410 nt, Artificial Sequence; identical to SEQ ID NO: 167313
  derived and/or modified sequence opt4 from neuraminidase__InfluenzaA__ABD15760

SEQ ID NO: 167315 - RNA, 1410 nt, Artificial Sequence; identical to SEQ ID NO: 167250
  derived and/or modified sequence opt4 from neuraminidase__InfluenzaA__ABD15771

SEQ ID NO: 167316 - RNA, 1410 nt, Artificial Sequence; identical to SEQ ID NO: 167250
  derived and/or modified sequence opt4 from neuraminidase__InfluenzaA__ABD15782

SEQ ID NO: 167317 - RNA, 1410 nt, Artificial Sequence; identical to SEQ ID NO: 167250
  derived and/or modified sequence opt4 from neuraminidase__InfluenzaA__ABD15793

SEQ ID NO: 167318 - RNA, 1410 nt, Artificial Sequence; identical to SEQ ID NO: 167234
  derived and/or modified sequence opt4 from neuraminidase__InfluenzaA__ABD16306

SEQ ID NO: 167319 - RNA, 1410 nt, Artificial Sequence
  derived and/or modified sequence opt4 from neuraminidase__InfluenzaA__ABD16317
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167320 - RNA, 1410 nt, Artificial Sequence; identical to SEQ ID NO: 167234
  derived and/or modified sequence opt4 from neuraminidase__InfluenzaA__ABD16328

SEQ ID NO: 167321 - RNA, 1410 nt, Artificial Sequence
  derived and/or modified sequence opt4 from neuraminidase__InfluenzaA__ABD16339
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167322 - RNA, 1410 nt, Artificial Sequence
  derived and/or modified sequence opt4 from neuraminidase__InfluenzaA__ABD16361
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcaagcugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167323 - RNA, 1410 nt, Artificial Sequence; identical to SEQ ID NO: 167234
  derived and/or modified sequence opt4 from neuraminidase__InfluenzaA__ABD16475

SEQ ID NO: 167324 - RNA, 1410 nt, Artificial Sequence; identical to SEQ ID NO: 167234
  derived and/or modified sequence opt4 from neuraminidase__InfluenzaA__ABD16486

SEQ ID NO: 167325 - RNA, 1410 nt, Artificial Sequence; identical to SEQ ID NO: 167261
  derived and/or modified sequence opt4 from neuraminidase__InfluenzaA__ABD16497

SEQ ID NO: 167326 - RNA, 1410 nt, Artificial Sequence; identical to SEQ ID NO: 167234
  derived and/or modified sequence opt4 from neuraminidase__InfluenzaA__ABD16508

SEQ ID NO: 167327 - RNA, 1410 nt, Artificial Sequence
  derived and/or modified sequence opt4 from neuraminidase__InfluenzaA__ABD16519
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167328 - RNA, 1410 nt, Artificial Sequence
  derived and/or modified sequence opt4 from neuraminidase__InfluenzaA__ABD16530
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagaugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167329 - RNA, 1410 nt, Artificial Sequence; identical to SEQ ID NO: 167111
  derived and/or modified sequence opt4 from neuraminidase__InfluenzaA__ABD16541

SEQ ID NO: 167330 - RNA, 1410 nt, Artificial Sequence; identical to SEQ ID NO: 167234
  derived and/or modified sequence opt4 from neuraminidase__InfluenzaA__ABD16552

SEQ ID NO: 167331 - RNA, 1410 nt, Artificial Sequence; identical to SEQ ID NO: 167233
  derived and/or modified sequence opt4 from neuraminidase__InfluenzaA__ABD16563

SEQ ID NO: 167332 - RNA, 1410 nt, Artificial Sequence
  derived and/or modified sequence opt4 from neuraminidase__InfluenzaA__ABD16574
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagaaggagaccagagugugguggaccagcaacagcaucgugguguucugcggcaccagcggcaccuacggcaccggcagcuggcccgacggcgccgacaucaaccugaugcccaucuga

SEQ ID NO: 167333 - RNA, 1410 nt, Artificial Sequence
  derived and/or modified sequence opt4 from neuraminidase__InfluenzaA__ABD16585
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167334 - RNA, 1410 nt, Artificial Sequence
  derived and/or modified sequence opt4 from neuraminidase__InfluenzaA__ABD16721
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccaagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugccagaaccccaacaacgagaagggcaaccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcaagaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167335 - RNA, 1410 nt, Artificial Sequence; identical to SEQ ID NO: 167004
  derived and/or modified sequence opt4 from neuraminidase__InfluenzaA__ABD16732

SEQ ID NO: 167336 - RNA, 1410 nt, Artificial Sequence
  derived and/or modified sequence opt4 from neuraminidase__InfluenzaA__ABD16743
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaccagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcagcagcuacugcagaaaccccaacaacgagaagggcacccacggcgugaagggcugggccuucgacgacggcaacgacguguggaugggcagaaccaucagcgaggacagcagaagcggcuacgagaccuucaaggugaucggcggcuggagcacccccaacagcaagcugcagaugaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167337 - RNA, 1410 nt, Artificial Sequence; identical to SEQ ID NO: 167096
  derived and/or modified sequence opt4 from neuraminidase__InfluenzaA__ABD16754

SEQ ID NO: 167338 - RNA, 1410 nt, Artificial Sequence; identical to SEQ ID NO: 167194
  derived and/or modified sequence opt4 from neuraminidase__InfluenzaA__ABD16765

SEQ ID NO: 167339 - RNA, 1410 nt, Artificial Sequence; identical to SEQ ID NO: 166638
  derived and/or modified sequence opt4 from neuraminidase__InfluenzaA__ABD17326

SEQ ID NO: 167340 - RNA, 1410 nt, Artificial Sequence
  derived and/or modified sequence opt4 from neuraminidase__InfluenzaA__ABD38137
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucaucgacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagcccgaggugugguggaccagcaacagcaucgugguguucugcggcacccccggcaccuacggcaccggcagcuggcccgacggcgccgacaucaaccugaugcccaucuga

SEQ ID NO: 167341 - RNA, 1413 nt, Artificial Sequence; identical to SEQ ID NO: 166906
  derived and/or modified sequence opt4 from neuraminidase__InfluenzaA__ABD60782

SEQ ID NO: 167342 - RNA, 1410 nt, Artificial Sequence
  derived and/or modified sequence opt4 from neuraminidase__InfluenzaA__ABD60793
augaaccccaaccagaagaucaucaccaucggcagcgugagccugaccaucgccaccaucugcuuccugaugcagaucgccauccuggugaccaccgugacccugcacuucaagcaguacgagugcgacagccccgugaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucgugagcuggagccagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgaccuguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucaucguguucugcggcaccagcggcaccuacggcaccggcagcuggcccgacggcgccgacaucaaccugaugcccaucuga

SEQ ID NO: 167343 - RNA, 1410 nt, Artificial Sequence; identical to SEQ ID NO: 167039
  derived and/or modified sequence opt4 from neuraminidase__InfluenzaA__ABD60804

SEQ ID NO: 167344 - RNA, 1410 nt, Artificial Sequence; identical to SEQ ID NO: 167232
  derived and/or modified sequence opt4 from neuraminidase__InfluenzaA__ABD60815

SEQ ID NO: 167345 - RNA, 1410 nt, Artificial Sequence; identical to SEQ ID NO: 167234
  derived and/or modified sequence opt4 from neuraminidase__InfluenzaA__ABD60826

SEQ ID NO: 167346 - RNA, 1410 nt, Artificial Sequence; identical to SEQ ID NO: 167313
  derived and/or modified sequence opt4 from neuraminidase__InfluenzaA__ABD60837

SEQ ID NO: 167347 - RNA, 1410 nt, Artificial Sequence
  derived and/or modified sequence opt4 from neuraminidase__InfluenzaA__ABD60848
augaaccccaaccagaagaucaucaccaucggcagcgugagccugaccaucgccaccaucugcuuccugaugcagguggccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167348 - RNA, 1413 nt, Artificial Sequence
  derived and/or modified sequence opt4 from neuraminidase__InfluenzaA__ABD60881
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167349 - RNA, 1413 nt, Artificial Sequence
  derived and/or modified sequence opt4 from neuraminidase__InfluenzaA__ABD60892
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagagugaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167350 - RNA, 1413 nt, Artificial Sequence; identical to SEQ ID NO: 167348
  derived and/or modified sequence opt4 from neuraminidase__InfluenzaA__ABD60903

SEQ ID NO: 167351 - RNA, 1413 nt, Artificial Sequence; identical to SEQ ID NO: 166935
  derived and/or modified sequence opt4 from neuraminidase__InfluenzaA__ABD60914

SEQ ID NO: 167352 - RNA, 1410 nt, Artificial Sequence
  derived and/or modified sequence opt4 from neuraminidase__InfluenzaA__ABD60925
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167353 - RNA, 1413 nt, Artificial Sequence
  derived and/or modified sequence opt4 from neuraminidase__InfluenzaA__ABD60947
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucagcaacaccaacgugguggccggcaaggacaccaccagcaugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagcagauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 167354 - RNA, 1410 nt, Artificial Sequence
  derived and/or modified sequence opt4 from neuraminidase__InfluenzaA__ABD61263
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcaugaagggcugggccuucgacgacggcaacgacguguggaugggcagaaccaucagcgagaagcugagaagcggcuacgagaccuucaaggugaucgagggcuggagcaagcccaacagcaagcugcaggugaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167355 - RNA, 1410 nt, Artificial Sequence; identical to SEQ ID NO: 166665
  derived and/or modified sequence opt4 from neuraminidase__InfluenzaA__ABD61274

SEQ ID NO: 167356 - RNA, 1410 nt, Artificial Sequence
  derived and/or modified sequence opt4 from neuraminidase__InfluenzaA__ABD61285
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcaacgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167357 - RNA, 1410 nt, Artificial Sequence; identical to SEQ ID NO: 167111
  derived and/or modified sequence opt4 from neuraminidase__InfluenzaA__ABD61296

SEQ ID NO: 167358 - RNA, 1410 nt, Artificial Sequence; identical to SEQ ID NO: 167232
  derived and/or modified sequence opt4 from neuraminidase__InfluenzaA__ABD61307

SEQ ID NO: 167359 - RNA, 1410 nt, Artificial Sequence; identical to SEQ ID NO: 167250
  derived and/or modified sequence opt4 from neuraminidase__InfluenzaA__ABD61318

SEQ ID NO: 167360 - RNA, 1410 nt, Artificial Sequence; identical to SEQ ID NO: 166581
  derived and/or modified sequence opt4 from neuraminidase__InfluenzaA__ABD61340

SEQ ID NO: 167361 - RNA, 1410 nt, Artificial Sequence; identical to SEQ ID NO: 166581
  derived and/or modified sequence opt4 from neuraminidase__InfluenzaA__ABD61351

SEQ ID NO: 167362 - RNA, 1410 nt, Artificial Sequence
  derived and/or modified sequence opt4 from neuraminidase__InfluenzaA__ABD61362
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggaggugugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucgaccugaugcccaucuga

SEQ ID NO: 167363 - RNA, 1410 nt, Artificial Sequence; identical to SEQ ID NO: 167313
  derived and/or modified sequence opt4 from neuraminidase__InfluenzaA__ABD61373

SEQ ID NO: 167364 - RNA, 1410 nt, Artificial Sequence
  derived and/or modified sequence opt4 from neuraminidase__InfluenzaA__ABD61384
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167365 - RNA, 1410 nt, Artificial Sequence; identical to SEQ ID NO: 167250
  derived and/or modified sequence opt4 from neuraminidase__InfluenzaA__ABD61395

SEQ ID NO: 167366 - RNA, 1410 nt, Artificial Sequence; identical to SEQ ID NO: 167347
  derived and/or modified sequence opt4 from neuraminidase__InfluenzaA__ABD61406

SEQ ID NO: 167367 - RNA, 1413 nt, Artificial Sequence; identical to SEQ ID NO: 167348
  derived and/or modified sequence opt4 from neuraminidase__InfluenzaA__ABD61521

SEQ ID NO: 167368 - RNA, 1410 nt, Artificial Sequence
  derived and/or modified sequence opt4 from neuraminidase__InfluenzaA__ABD61532
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcgagaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucagccugaugcccaucuga

SEQ ID NO: 167369 - RNA, 1413 nt, Artificial Sequence
  derived and/or modified sequence opt4 from neuraminidase__InfluenzaA__ABD61543
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcaacuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167370 - RNA, 1413 nt, Artificial Sequence; identical to SEQ ID NO: 167348
  derived and/or modified sequence opt4 from neuraminidase__InfluenzaA__ABD63066

SEQ ID NO: 167371 - RNA, 1410 nt, Artificial Sequence; identical to SEQ ID NO: 166773
  derived and/or modified sequence opt4 from neuraminidase__InfluenzaA__ABD77601

SEQ ID NO: 167372 - RNA, 1410 nt, Artificial Sequence
  derived and/or modified sequence opt4 from neuraminidase__InfluenzaA__ABD77612
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaugugccccaagcuggccgaguacagaaacuggcugaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcaucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucaaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaggccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167373 - RNA, 1410 nt, Artificial Sequence
  derived and/or modified sequence opt4 from neuraminidase__InfluenzaA__ABD77634
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaugugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcaucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucaaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaggccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167374 - RNA, 1410 nt, Artificial Sequence; identical to SEQ ID NO: 167373
  derived and/or modified sequence opt4 from neuraminidase__InfluenzaA__ABD77645

SEQ ID NO: 167375 - RNA, 1410 nt, Artificial Sequence; identical to SEQ ID NO: 167373
  derived and/or modified sequence opt4 from neuraminidase__InfluenzaA__ABD77656

SEQ ID NO: 167376 - RNA, 1410 nt, Artificial Sequence; identical to SEQ ID NO: 166646
  derived and/or modified sequence opt4 from neuraminidase__InfluenzaA__ABD77700

SEQ ID NO: 167377 - RNA, 1413 nt, Artificial Sequence; identical to SEQ ID NO: 167348
  derived and/or modified sequence opt4 from neuraminidase__InfluenzaA__ABD77722

SEQ ID NO: 167378 - RNA, 1413 nt, Artificial Sequence; identical to SEQ ID NO: 167348
  derived and/or modified sequence opt4 from neuraminidase__InfluenzaA__ABD77733

SEQ ID NO: 167379 - RNA, 1410 nt, Artificial Sequence
  derived and/or modified sequence opt4 from neuraminidase__InfluenzaA__ABD77744
augaaccccaaccagaagaucaucaccaucggcagcgugagccugaccaucgccaccaucugcuuccugaugcagaucgugauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167380 - RNA, 1410 nt, Artificial Sequence; identical to SEQ ID NO: 167373
  derived and/or modified sequence opt4 from neuraminidase__InfluenzaA__ABD77755

SEQ ID NO: 167381 - RNA, 1410 nt, Artificial Sequence; identical to SEQ ID NO: 167373
  derived and/or modified sequence opt4 from neuraminidase__InfluenzaA__ABD77766

SEQ ID NO: 167382 - RNA, 1410 nt, Artificial Sequence
  derived and/or modified sequence opt4 from neuraminidase__InfluenzaA__ABD77777
augaaccccaaccagaagaucaucaccaucggcagcgugagccugaccaucgccaccaucugcuuccugaugcagaucgugauccuggugaccaccgugacccugcacuucaagcaguacgagugcaacagcccccccaacaaccaggugaugcccugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167383 - RNA, 1410 nt, Artificial Sequence; identical to SEQ ID NO: 167382
  derived and/or modified sequence opt4 from neuraminidase__InfluenzaA__ABD77788

SEQ ID NO: 167384 - RNA, 1362 nt, Artificial Sequence
  derived and/or modified sequence opt4 from neuraminidase__InfluenzaA__ABD77799
augaaccccaaccagaagaucaucaccaucggcagcaucugcaugguggugggcaucaucagccugauccugcagaucggcaacaucaucagcaucuggaucagccacagcauccagaccggcaaccagaaccacaccggcaucugcaaccagggcaucaucaccuacaacgugguggccggccaggacagcaccagcgugauccugaccggcaacagcagccugugccccaucagaggcugggccauccacagcaaggacaacggcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcaccugcgugaacggcagcugcuucaccaucaugaccgacggccccagcaacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccaaggacggcaccggcagcugcggccccgugagcgccgacggcgccaacggcgugaagggcuucagcuacagauacggcaacggcguguggaucggcagaaccaagagcgacagcagcagacacggcuucgagaugaucugggaccccaacggcuggaccgagaccgacagcagauucagcgugagacaggacgugguggccaugaccgacagaagcggcuacagcggcagcuucgugcagcaccccgagcugaccggccuggacugcaugagacccugcuucuggguggagcugaucagaggcagacccgaggaggagaccaucuggaccagcggcagcaucaucagcuucugcggcgugaacagcgacaccguggacuggagcuggcccgacggcgccgagcugcccuucaccaucgacaaguga

SEQ ID NO: 167385 - RNA, 1410 nt, Artificial Sequence
  derived and/or modified sequence opt4 from neuraminidase__InfluenzaA__ABD77810
augaaccccaaccagaagaucaucaccaucggcagcaucugcaugguggugggcaucaucagccugauccugcagaucggcaacaucgugagcaucuggaucagccacagcauccagaccggcaaccagaaccacaccggcaccugcaaccagagcaucaucaccuacaagaacagcaccugggugaaccagaccuacgugaacaucagcaacaccaacgugguggccggcaaggacaccaccagcgugauccuggccggcaacagcagccugugccccaucagaggcugggccaucuacagcaaggacaacggcgugagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaaggagauccugagaacccaggagagcgagugcgugugcgugaacggcagcugcuucaccaucaugaccgacggccccagcggcggccccgccagcuacaagaucuucaagaucgagaagggcaaggugaccaagagcaucgagcuggacgcccccaacagccacuacgaggagugcagcugcuaccccgacaccagcaaggugaugugcgugugcagagacaacuggcacggcagcaacagacccugggugagcuucgaccagaaccuggacuaccagaugggcuacaucugcagcggcguguucggcgacaaccccagacccaaggacggcaagggcagcugcggccccguguacguggacggcgccaacggcgugaagggcuucagcuacagauacggcaacggcguguggaucggcagaaccaagagcaacagcagcagacagggcuucgagaugaucugggaccccaacggcuggaccgagaccgacagcaacuucuucaccaagcaggacgugguggccgugaccgacuggagcggcuacagcggcagcuucgugcagcaccccgagcugaccggccuggacugcaugagacccugcuucuggguggagcugaucagaggcagacccaaggagaacaccaucuggaccagcggcagcagcaucagcuucugcggcgugaacagcgacaccguggacuggagcuggcccgacggcgccgagcugcccuucaccaucgacaaguga

SEQ ID NO: 167386 - RNA, 1410 nt, Artificial Sequence
  derived and/or modified sequence opt4 from neuraminidase__InfluenzaA__ABD77832
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacggcggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauacagcggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167387 - RNA, 1410 nt, Artificial Sequence
  derived and/or modified sequence opt4 from neuraminidase__InfluenzaA__ABD77876
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauacagcggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167388 - RNA, 1410 nt, Artificial Sequence; identical to SEQ ID NO: 166646
  derived and/or modified sequence opt4 from neuraminidase__InfluenzaA__ABD77887

SEQ ID NO: 167389 - RNA, 1410 nt, Artificial Sequence
  derived and/or modified sequence opt4 from neuraminidase__InfluenzaA__ABD77898
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcagcgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167390 - RNA, 1410 nt, Artificial Sequence
  derived and/or modified sequence opt4 from neuraminidase__InfluenzaA__ABD77909
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagcagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167391 - RNA, 1413 nt, Artificial Sequence; identical to SEQ ID NO: 167348
  derived and/or modified sequence opt4 from neuraminidase__InfluenzaA__ABD77920

SEQ ID NO: 167392 - RNA, 1413 nt, Artificial Sequence; identical to SEQ ID NO: 167348
  derived and/or modified sequence opt4 from neuraminidase__InfluenzaA__ABD77931

SEQ ID NO: 167393 - RNA, 1413 nt, Artificial Sequence; identical to SEQ ID NO: 167348
  derived and/or modified sequence opt4 from neuraminidase__InfluenzaA__ABD77942

SEQ ID NO: 167394 - RNA, 1413 nt, Artificial Sequence
  derived and/or modified sequence opt4 from neuraminidase__InfluenzaA__ABD77953
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucgugcagcaccccgagcugaccggccuggacugcaucagacccugcuuccugguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167395 - RNA, 1413 nt, Artificial Sequence
  derived and/or modified sequence opt4 from neuraminidase__InfluenzaA__ABD77964
augaaccccaaccagaagaucaucaccaucggcagcaucagcaucgccaucggcaucaucagccugaugcugcagaucggcaacaucaucagcaucugggccagccacagcauccagaccagaagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167396 - RNA, 1413 nt, Artificial Sequence; identical to SEQ ID NO: 167348
  derived and/or modified sequence opt4 from neuraminidase__InfluenzaA__ABD77975

SEQ ID NO: 167397 - RNA, 1413 nt, Artificial Sequence; identical to SEQ ID NO: 167348
  derived and/or modified sequence opt4 from neuraminidase__InfluenzaA__ABD77986

SEQ ID NO: 167398 - RNA, 1413 nt, Artificial Sequence
  derived and/or modified sequence opt4 from neuraminidase__InfluenzaA__ABD77997
augaaccccaaccagaagaucaucaccaucggcagcaucagcaucgccaucggcauccugagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacaacaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167399 - RNA, 1413 nt, Artificial Sequence; identical to SEQ ID NO: 167348
  derived and/or modified sequence opt4 from neuraminidase__InfluenzaA__ABD78008

SEQ ID NO: 167400 - RNA, 1413 nt, Artificial Sequence; identical to SEQ ID NO: 167348
  derived and/or modified sequence opt4 from neuraminidase__InfluenzaA__ABD78019

SEQ ID NO: 167401 - RNA, 1413 nt, Artificial Sequence
  derived and/or modified sequence opt4 from neuraminidase__InfluenzaA__ABD78030
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacagaaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccaacaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167402 - RNA, 1413 nt, Artificial Sequence
  derived and/or modified sequence opt4 from neuraminidase__InfluenzaA__ABD78041
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccagcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167403 - RNA, 1410 nt, Artificial Sequence; identical to SEQ ID NO: 167382
  derived and/or modified sequence opt4 from neuraminidase__InfluenzaA__ABD78052

SEQ ID NO: 167404 - RNA, 1413 nt, Artificial Sequence; identical to SEQ ID NO: 166916
  derived and/or modified sequence opt4 from neuraminidase__InfluenzaA__ABD78063

SEQ ID NO: 167405 - RNA, 1413 nt, Artificial Sequence; identical to SEQ ID NO: 166916
  derived and/or modified sequence opt4 from neuraminidase__InfluenzaA__ABD78074

SEQ ID NO: 167406 - RNA, 1413 nt, Artificial Sequence; identical to SEQ ID NO: 166916
  derived and/or modified sequence opt4 from neuraminidase__InfluenzaA__ABD78085

SEQ ID NO: 167407 - RNA, 1413 nt, Artificial Sequence; identical to SEQ ID NO: 166916
  derived and/or modified sequence opt4 from neuraminidase__InfluenzaA__ABD78096

SEQ ID NO: 167408 - RNA, 1410 nt, Artificial Sequence
  derived and/or modified sequence opt4 from neuraminidase__InfluenzaA__ABD78118
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaugugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauacagcggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167409 - RNA, 1410 nt, Artificial Sequence; identical to SEQ ID NO: 167408
  derived and/or modified sequence opt4 from neuraminidase__InfluenzaA__ABD78129

SEQ ID NO: 167410 - RNA, 1410 nt, Artificial Sequence; identical to SEQ ID NO: 166638
  derived and/or modified sequence opt4 from neuraminidase__InfluenzaA__ABD79035

SEQ ID NO: 167411 - RNA, 1353 nt, Artificial Sequence
  derived and/or modified sequence opt4 from neuraminidase__InfluenzaA__ABD79115
augaaccccaaccagaagaucaucaccaucggcagcaucugcaugguggugggcaucaucagccugaucuuccagaucggcaacaucgugagcaucuggaucagccacagcaucaccggcaccugcaacagaagcaucuacgugaacaucagcaacaccaacgugguggccggcaaggacaccaccagcgugauccuggccggcaacagcagccugugccccaucagaggcugggccaucuacagcaaggacaacggcgugagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagaacccugaugagcugccccgugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccggcaccaucaagagcuggagaaaggagauccugagaacccaggagagcgagugcgugugcgugaacggcagcugcuucaccaucaugaccgacggccccagcggcggccccgccagcuacaagaucuucaagaucgagaagggcaaggugaccaagagcaucgagcuggacgcccccaacagccacuacgaggagugcagcugcuaccccgacaccagcaaggugaugugcgugugcagagacaacuggcacggcagcaacagacccugggugagcuucgaccagaaccuggacuaccagaugggcuacaucugcagcggcguguucggcgacaaccccagacccaaggacggcaagggcagcugcggccccguguacguggacggcgccaacggcgugaagggcuucagcuacagauacggcaacggcguguggaucggcagaaccaagagcagcagcagcagacagggcuucgagaugaucugggaccccaacggcuggaccgagaccgacagcaacuucuucaugaagcaggacgugguggccgugaccgacuggagcggcuacagcggcagcuucgugcagcaccccgagcugaccggccuggacugcaugagacccugcuucuggguggagcugaucagaggcagacccaaggagaacaccaucuggaccagcggcagcagcaucagcuucugcggcgugaacagcgacaccguggacuggagcuggcccgacggcgccgagcugcccuucaccaucgacaaguga

SEQ ID NO: 167412 - RNA, 1410 nt, Artificial Sequence
  derived and/or modified sequence opt4 from neuraminidase__InfluenzaA__ABD79126
augaaccccaaccagaagaucaucaccaucggcagcgugagccugaccaucaccaccaucugcuuccugaugcagaucgccauccuggugaucaccgugacccugcacuucaagcagugcgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccuggaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacaagggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167413 - RNA, 1410 nt, Artificial Sequence; identical to SEQ ID NO: 167412
  derived and/or modified sequence opt4 from neuraminidase__InfluenzaA__ABD79137

SEQ ID NO: 167414 - RNA, 1410 nt, Artificial Sequence; identical to SEQ ID NO: 167412
  derived and/or modified sequence opt4 from neuraminidase__InfluenzaA__ABD79148

SEQ ID NO: 167415 - RNA, 1410 nt, Artificial Sequence; identical to SEQ ID NO: 167412
  derived and/or modified sequence opt4 from neuraminidase__InfluenzaA__ABD79159

SEQ ID NO: 167416 - RNA, 1410 nt, Artificial Sequence
  derived and/or modified sequence opt4 from neuraminidase__InfluenzaA__ABD79170
augaaccccaaccagaagaucaucaccaucggcagcgugagccugaccaucaccaccaucugcuuccugaugcagaucgccauccuggugaucaccgugacccugcacuucaagcagugcgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacaacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucaaggagggcaagaucgugcacgugagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccuggaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacaagggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167417 - RNA, 1410 nt, Artificial Sequence; identical to SEQ ID NO: 167412
  derived and/or modified sequence opt4 from neuraminidase__InfluenzaA__ABD79181

SEQ ID NO: 167418 - RNA, 1410 nt, Artificial Sequence; identical to SEQ ID NO: 167412
  derived and/or modified sequence opt4 from neuraminidase__InfluenzaA__ABD79192

SEQ ID NO: 167419 - RNA, 1410 nt, Artificial Sequence
  derived and/or modified sequence opt4 from neuraminidase__InfluenzaA__ABD79203
augaaccccaaccagaagaucaucaccaucggcagcgugagccugaccaucaccaccaucugcuuccugaugcagaucgccauccuggugaucaccgugacccugcacuucaagcagugcgagugcaacagcccccccaacaaccaggugaugcugugcgagcccaccaucaucgagagaaacaucaccgagaucguguaccugaccaacaccaccaucgagaaggagaagugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacaugaaggacuacagcaucgugagcagcuacgugugcagcggccuggugggcgacacccccagaaagaacgacagcagcagcagcagcuacugccuggaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacaagggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167420 - RNA, 1410 nt, Artificial Sequence; identical to SEQ ID NO: 167412
  derived and/or modified sequence opt4 from neuraminidase__InfluenzaA__ABD79214

SEQ ID NO: 167421 - RNA, 1410 nt, Artificial Sequence
  derived and/or modified sequence opt4 from neuraminidase__InfluenzaA__ABD79236
augaaccccaaccagaagaucaucaccaucggcagcgugagccugaccaucaccaccaucugcuuccugaugcagaucgccauccuggugaucaccgugacccugcacuucaagcagugcgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacaacaccgcccacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucaaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccuggaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacaagggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167422 - RNA, 1410 nt, Artificial Sequence
  derived and/or modified sequence opt4 from neuraminidase__InfluenzaA__ABD79247
augaaccccaaccagaagaucaucaccaucggcagcgugagccugaccaucaccaccaucugcuuccugaugcagaucgccauccuggugaucaccgugacccugcacuucaagcagugcgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccuggaccccaacaacgaggagggcggccacggcgugaagggcugggccuucgacgacggcaacgacguguggaugggcagaaccaucagcgagaagcugagaagcggcuacgagaccuucaaggugaugggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167423 - RNA, 1410 nt, Artificial Sequence; identical to SEQ ID NO: 166847
  derived and/or modified sequence opt4 from neuraminidase__InfluenzaA__ABD94737

SEQ ID NO: 167424 - RNA, 1410 nt, Artificial Sequence; identical to SEQ ID NO: 167232
  derived and/or modified sequence opt4 from neuraminidase__InfluenzaA__ABD94748

SEQ ID NO: 167425 - RNA, 1413 nt, Artificial Sequence; identical to SEQ ID NO: 167348
  derived and/or modified sequence opt4 from neuraminidase__InfluenzaA__ABD94759

SEQ ID NO: 167426 - RNA, 1410 nt, Artificial Sequence; identical to SEQ ID NO: 166581
  derived and/or modified sequence opt4 from neuraminidase__InfluenzaA__ABD94770

SEQ ID NO: 167427 - RNA, 1413 nt, Artificial Sequence; identical to SEQ ID NO: 166916
  derived and/or modified sequence opt4 from neuraminidase__InfluenzaA__ABD94792

SEQ ID NO: 167428 - RNA, 1413 nt, Artificial Sequence; identical to SEQ ID NO: 166916
  derived and/or modified sequence opt4 from neuraminidase__InfluenzaA__ABD94803

SEQ ID NO: 167429 - RNA, 1413 nt, Artificial Sequence; identical to SEQ ID NO: 166916
  derived and/or modified sequence opt4 from neuraminidase__InfluenzaA__ABD94814

SEQ ID NO: 167430 - RNA, 1410 nt, Artificial Sequence; identical to SEQ ID NO: 167093
  derived and/or modified sequence opt4 from neuraminidase__InfluenzaA__ABD94825

SEQ ID NO: 167431 - RNA, 1410 nt, Artificial Sequence
  derived and/or modified sequence opt4 from neuraminidase__InfluenzaA__ABD94847
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaagaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgugaccaagauccuguucaucgaggagggcaagaucgugcacaucagcccccugcugggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167432 - RNA, 1410 nt, Artificial Sequence; identical to SEQ ID NO: 166646
  derived and/or modified sequence opt4 from neuraminidase__InfluenzaA__ABD94858

SEQ ID NO: 167433 - RNA, 1410 nt, Artificial Sequence; identical to SEQ ID NO: 166646
  derived and/or modified sequence opt4 from neuraminidase__InfluenzaA__ABD94880

SEQ ID NO: 167434 - RNA, 1410 nt, Artificial Sequence
  derived and/or modified sequence opt4 from neuraminidase__InfluenzaA__ABD94891
augaaccccaaccagaagaucaucaccaucggcagcgugagccugaccaucaccaccaucugcuuccugaugcagaucgccauccuggugaucaccgugacccugcacuucaagcagugcgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaaggugcuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccuggaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167435 - RNA, 1410 nt, Artificial Sequence; identical to SEQ ID NO: 167412
  derived and/or modified sequence opt4 from neuraminidase__InfluenzaA__ABD94902

SEQ ID NO: 167436 - RNA, 1410 nt, Artificial Sequence
  derived and/or modified sequence opt4 from neuraminidase__InfluenzaA__ABD94924
augaaccccaaccagaagaucaucaccaucggcagcgugagccugaccaucgccaccaucugccugcugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagccagcugcugggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167437 - RNA, 1410 nt, Artificial Sequence
  derived and/or modified sequence opt4 from neuraminidase__InfluenzaA__ABD94946
augaaccccaaccagaagaucaucaccaucggcagcgugagccugaccaucgccaccaucugcuuccugacccagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 167438 - RNA, 1410 nt, Artificial Sequence
  derived and/or modified sequence opt4 from neuraminidase__InfluenzaA__ABD94957
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagagcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167439 - RNA, 1413 nt, Artificial Sequence; identical to SEQ ID NO: 167348
  derived and/or modified sequence opt4 from neuraminidase__InfluenzaA__ABD94968

SEQ ID NO: 167440 - RNA, 1413 nt, Artificial Sequence; identical to SEQ ID NO: 167348
  derived and/or modified sequence opt4 from neuraminidase__InfluenzaA__ABD94990

SEQ ID NO: 167441 - RNA, 1413 nt, Artificial Sequence
  derived and/or modified sequence opt4 from neuraminidase__InfluenzaA__ABD95001
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacauccacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcaugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167442 - RNA, 1413 nt, Artificial Sequence
  derived and/or modified sequence opt4 from neuraminidase__InfluenzaA__ABD95012
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167443 - RNA, 1413 nt, Artificial Sequence; identical to SEQ ID NO: 167348
  derived and/or modified sequence opt4 from neuraminidase__InfluenzaA__ABD95023

SEQ ID NO: 167444 - RNA, 1413 nt, Artificial Sequence
  derived and/or modified sequence opt4 from neuraminidase__InfluenzaA__ABD95034
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucauccagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167445 - RNA, 1413 nt, Artificial Sequence
  derived and/or modified sequence opt4 from neuraminidase__InfluenzaA__ABD95056
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaagaucaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccugaacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167446 - RNA, 1413 nt, Artificial Sequence; identical to SEQ ID NO: 166916
  derived and/or modified sequence opt4 from neuraminidase__InfluenzaA__ABD95067

SEQ ID NO: 167447 - RNA, 1413 nt, Artificial Sequence; identical to SEQ ID NO: 166916
  derived and/or modified sequence opt4 from neuraminidase__InfluenzaA__ABD95078

SEQ ID NO: 167448 - RNA, 1413 nt, Artificial Sequence; identical to SEQ ID NO: 167445
  derived and/or modified sequence opt4 from neuraminidase__InfluenzaA__ABD95089

SEQ ID NO: 167449 - RNA, 1413 nt, Artificial Sequence; identical to SEQ ID NO: 166916
  derived and/or modified sequence opt4 from neuraminidase__InfluenzaA__ABD95100

SEQ ID NO: 167450 - RNA, 1413 nt, Artificial Sequence
  derived and/or modified sequence opt4 from neuraminidase__InfluenzaA__ABD95111
augaaccccaaccagaagaucaucaccaucggcagcaucagcaucgccaucggcaugaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167451 - RNA, 1413 nt, Artificial Sequence; identical to SEQ ID NO: 167450
  derived and/or modified sequence opt4 from neuraminidase__InfluenzaA__ABD95122

SEQ ID NO: 167452 - RNA, 1413 nt, Artificial Sequence; identical to SEQ ID NO: 166916
  derived and/or modified sequence opt4 from neuraminidase__InfluenzaA__ABD95144

SEQ ID NO: 167453 - RNA, 1413 nt, Artificial Sequence; identical to SEQ ID NO: 166916
  derived and/or modified sequence opt4 from neuraminidase__InfluenzaA__ABD95155

SEQ ID NO: 167454 - RNA, 1413 nt, Artificial Sequence
  derived and/or modified sequence opt4 from neuraminidase__InfluenzaA__ABD95166
augaaccccaaccagaagaucaucaccaucggcagcaucagcaucgccaucggcaugaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167455 - RNA, 1413 nt, Artificial Sequence; identical to SEQ ID NO: 167445
  derived and/or modified sequence opt4 from neuraminidase__InfluenzaA__ABD95177

SEQ ID NO: 167456 - RNA, 1413 nt, Artificial Sequence
  derived and/or modified sequence opt4 from neuraminidase__InfluenzaA__ABD95188
augaaccccaaccagaagaucaucaccaucggcagcaucagcaccaccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167457 - RNA, 1413 nt, Artificial Sequence; identical to SEQ ID NO: 167445
  derived and/or modified sequence opt4 from neuraminidase__InfluenzaA__ABD95199

SEQ ID NO: 167458 - RNA, 1413 nt, Artificial Sequence; identical to SEQ ID NO: 166935
  derived and/or modified sequence opt4 from neuraminidase__InfluenzaA__ABD95210

SEQ ID NO: 167459 - RNA, 1413 nt, Artificial Sequence
  derived and/or modified sequence opt4 from neuraminidase__InfluenzaA__ABD95221
augaaccccaaccagaagaucaucaccaucggcagcaucagcaucgccaucggcaugaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167460 - RNA, 1413 nt, Artificial Sequence; identical to SEQ ID NO: 167450
  derived and/or modified sequence opt4 from neuraminidase__InfluenzaA__ABD95232

SEQ ID NO: 167461 - RNA, 1413 nt, Artificial Sequence; identical to SEQ ID NO: 166916
  derived and/or modified sequence opt4 from neuraminidase__InfluenzaA__ABD95243

SEQ ID NO: 167462 - RNA, 1413 nt, Artificial Sequence; identical to SEQ ID NO: 167450
  derived and/or modified sequence opt4 from neuraminidase__InfluenzaA__ABD95254

SEQ ID NO: 167463 - RNA, 1413 nt, Artificial Sequence; identical to SEQ ID NO: 166935
  derived and/or modified sequence opt4 from neuraminidase__InfluenzaA__ABD95265

SEQ ID NO: 167464 - RNA, 1413 nt, Artificial Sequence; identical to SEQ ID NO: 166916
  derived and/or modified sequence opt4 from neuraminidase__InfluenzaA__ABD95276

SEQ ID NO: 167465 - RNA, 1413 nt, Artificial Sequence
  derived and/or modified sequence opt4 from neuraminidase__InfluenzaA__ABD95287
augaaccccaaccagaagaucaucaccaucggcagcaucagcguggccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167466 - RNA, 1413 nt, Artificial Sequence; identical to SEQ ID NO: 166916
  derived and/or modified sequence opt4 from neuraminidase__InfluenzaA__ABD95298

SEQ ID NO: 167467 - RNA, 1413 nt, Artificial Sequence
  derived and/or modified sequence opt4 from neuraminidase__InfluenzaA__ABD95309
augaaccccaaccagaagaucaucaccaucggcagcaucagcaucgccaucggcaugaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagugcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167468 - RNA, 1413 nt, Artificial Sequence; identical to SEQ ID NO: 166916
  derived and/or modified sequence opt4 from neuraminidase__InfluenzaA__ABD95320

SEQ ID NO: 167469 - RNA, 1413 nt, Artificial Sequence; identical to SEQ ID NO: 167445
  derived and/or modified sequence opt4 from neuraminidase__InfluenzaA__ABD95331

SEQ ID NO: 167470 - RNA, 1413 nt, Artificial Sequence
  derived and/or modified sequence opt4 from neuraminidase__InfluenzaA__ABD95342
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccgugagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcaucaacggcagcugcuucaccaucaugaccgacggccccagcaacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcggccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 167471 - RNA, 1413 nt, Artificial Sequence
  derived and/or modified sequence opt4 from neuraminidase__InfluenzaA__ABD95353
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucagcaacaccaacgugguggccggcaaggacaccaccagcaugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagcagauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 167472 - RNA, 1413 nt, Artificial Sequence; identical to SEQ ID NO: 167348
  derived and/or modified sequence opt4 from neuraminidase__InfluenzaA__ABE11660

SEQ ID NO: 167473 - RNA, 1413 nt, Artificial Sequence
  derived and/or modified sequence opt4 from neuraminidase__InfluenzaA__ABE11671
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaacaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167474 - RNA, 1413 nt, Artificial Sequence
  derived and/or modified sequence opt4 from neuraminidase__InfluenzaA__ABE11682
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167475 - RNA, 1413 nt, Artificial Sequence; identical to SEQ ID NO: 166916
  derived and/or modified sequence opt4 from neuraminidase__InfluenzaA__ABE11693

SEQ ID NO: 167476 - RNA, 1413 nt, Artificial Sequence; identical to SEQ ID NO: 166916
  derived and/or modified sequence opt4 from neuraminidase__InfluenzaA__ABE11704

SEQ ID NO: 167477 - RNA, 1413 nt, Artificial Sequence; identical to SEQ ID NO: 166916
  derived and/or modified sequence opt4 from neuraminidase__InfluenzaA__ABE11715

SEQ ID NO: 167478 - RNA, 1413 nt, Artificial Sequence; identical to SEQ ID NO: 167445
  derived and/or modified sequence opt4 from neuraminidase__InfluenzaA__ABE11726

SEQ ID NO: 167479 - RNA, 1413 nt, Artificial Sequence; identical to SEQ ID NO: 167450
  derived and/or modified sequence opt4 from neuraminidase__InfluenzaA__ABE11737

SEQ ID NO: 167480 - RNA, 1413 nt, Artificial Sequence; identical to SEQ ID NO: 166916
  derived and/or modified sequence opt4 from neuraminidase__InfluenzaA__ABE11815

SEQ ID NO: 167481 - RNA, 1413 nt, Artificial Sequence; identical to SEQ ID NO: 167445
  derived and/or modified sequence opt4 from neuraminidase__InfluenzaA__ABE11826

SEQ ID NO: 167482 - RNA, 1413 nt, Artificial Sequence; identical to SEQ ID NO: 167445
  derived and/or modified sequence opt4 from neuraminidase__InfluenzaA__ABE11837

SEQ ID NO: 167483 - RNA, 1413 nt, Artificial Sequence; identical to SEQ ID NO: 167445
  derived and/or modified sequence opt4 from neuraminidase__InfluenzaA__ABE11848

SEQ ID NO: 167484 - RNA, 1413 nt, Artificial Sequence; identical to SEQ ID NO: 167450
  derived and/or modified sequence opt4 from neuraminidase__InfluenzaA__ABE11859

SEQ ID NO: 167485 - RNA, 1413 nt, Artificial Sequence
  derived and/or modified sequence opt4 from neuraminidase__InfluenzaA__ABE11903
augaaccccaaccagaagaucaucaccaucggcagcaucagcauggccaucggcaucaucagccugauccugcagaucggcaacaucaucagcaucugggccagccacagcauccagaccggcagccagaacuacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 167486 - RNA, 1413 nt, Artificial Sequence
  derived and/or modified sequence opt4 from neuraminidase__InfluenzaA__ABE11925
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcaaggugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccgccgacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167487 - RNA, 1413 nt, Artificial Sequence
  derived and/or modified sequence opt4 from neuraminidase__InfluenzaA__ABE11952
augaaccccaaccagaagaucaucaccaucggcagcaucagcauggccaucggcaucaucagccugauccugcagaucggcaacaucaucagcaucugggccagccacagcauccagaccggcagccagaacuacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccgacuggagcuggcccgacggcgccgagcugcccuucaccaucgacaaguga

SEQ ID NO: 167488 - RNA, 1413 nt, Artificial Sequence
  derived and/or modified sequence opt4 from neuraminidase__InfluenzaA__ABE12035
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167489 - RNA, 1410 nt, Artificial Sequence; identical to SEQ ID NO: 167250
  derived and/or modified sequence opt4 from neuraminidase__InfluenzaA__ABE12094

SEQ ID NO: 167490 - RNA, 1410 nt, Artificial Sequence; identical to SEQ ID NO: 167382
  derived and/or modified sequence opt4 from neuraminidase__InfluenzaA__ABE12126

SEQ ID NO: 167491 - RNA, 1413 nt, Artificial Sequence; identical to SEQ ID NO: 166916
  derived and/or modified sequence opt4 from neuraminidase__InfluenzaA__ABE12263

SEQ ID NO: 167492 - RNA, 1410 nt, Artificial Sequence
  derived and/or modified sequence opt4 from neuraminidase__InfluenzaA__ABE12626
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaaguggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagagaggcaaccacggcgugaagggcugggccuucgacgacggcaacgacguguggaugggcagaaccaucagcaaggacagcagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167493 - RNA, 1410 nt, Artificial Sequence
  derived and/or modified sequence opt4 from neuraminidase__InfluenzaA__ABE12650
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucaaggagggcaagaucgugcacaucagcccccugcugggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167494 - RNA, 1410 nt, Artificial Sequence
  derived and/or modified sequence opt4 from neuraminidase__InfluenzaA__ABE13095
augaaccccaaccagaagaucaucaccaucggcagcgugagccugaccaucaccaccaucugcuuccugaugcagaucgccauccuggugaucaccgugacccugcacuucaagcagugcgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacggcagcagcagcagcuacugccuggaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacaagggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167495 - RNA, 1410 nt, Artificial Sequence; identical to SEQ ID NO: 166646
  derived and/or modified sequence opt4 from neuraminidase__InfluenzaA__ABE13332

SEQ ID NO: 167496 - RNA, 1410 nt, Artificial Sequence; identical to SEQ ID NO: 166646
  derived and/or modified sequence opt4 from neuraminidase__InfluenzaA__ABE13558

SEQ ID NO: 167497 - RNA, 1410 nt, Artificial Sequence
  derived and/or modified sequence opt4 from neuraminidase__InfluenzaA__ABE13642
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgagagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167498 - RNA, 1410 nt, Artificial Sequence
  derived and/or modified sequence opt4 from neuraminidase__InfluenzaA__ABE13668
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167499 - RNA, 1410 nt, Artificial Sequence
  derived and/or modified sequence opt4 from neuraminidase__InfluenzaA__ABE13836
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167500 - RNA, 1410 nt, Artificial Sequence
  derived and/or modified sequence opt4 from neuraminidase__InfluenzaA__ABE14033
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167501 - RNA, 1410 nt, Artificial Sequence
  derived and/or modified sequence opt4 from neuraminidase__InfluenzaA__ABE14055
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucagcagcuggagcaagaacauccugagaacccaggagagcgagugcgugugcaucaacggcaccugcaccguggugaugaccgacggcagcagcagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcgugaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167502 - RNA, 1410 nt, Artificial Sequence
  derived and/or modified sequence opt4 from neuraminidase__InfluenzaA__ABE14857
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaccaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167503 - RNA, 1410 nt, Artificial Sequence; identical to SEQ ID NO: 167500
  derived and/or modified sequence opt4 from neuraminidase__InfluenzaA__ABE15594

SEQ ID NO: 167504 - RNA, 1413 nt, Artificial Sequence
  derived and/or modified sequence opt4 from neuraminidase__InfluenzaA__ABE26994
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacagcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167505 - RNA, 1350 nt, Artificial Sequence
  derived and/or modified sequence opt4 from neuraminidase__InfluenzaA__ABE97641
augaaccccaaccagaagaucaucaccaucggcagcaucugcauggugaucggcaucaucagccugaugcugcagaucggcaacaugaucagcaucugggugagccacagcauccagaccuggaaccagcaccaggccgagagcaucagcaacaccaacccccugaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccuggaucagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaucggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaucgugagcuggagcuggcccgacggcgccgagcugcccuucaccaucgacaaguga

SEQ ID NO: 167506 - RNA, 1350 nt, Artificial Sequence
  derived and/or modified sequence opt4 from neuraminidase__InfluenzaA__ABE97642
augaaccccaaccagaagaucaucaccaucggcagcaucugcauggugaucggcauggugagccugaugcugcagaucggcaacaugaucagcaucuggcugagccacagcauccagaccggcaaccagcaccaggccgagagcaucagcaacaacaaccugcugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaucaucgacaaguga

SEQ ID NO: 167507 - RNA, 1350 nt, Artificial Sequence
  derived and/or modified sequence opt4 from neuraminidase__InfluenzaA__ABE97644
augaaccccaaccagaagaucaucaccaucggcagcaucugcauggugaucggcaucgugagccugaugcugcagaucggcaacaugaucagcaucugggugagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggcccugaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167508 - RNA, 1350 nt, Artificial Sequence
  derived and/or modified sequence opt4 from neuraminidase__InfluenzaA__ABE97645
augaaccccaaccagaagaucaucaccaucggcagcaucugcauggugaucggcaccgugagccugaugcugcagaucggcaacaugaucagcaucugggugagccacagcauccagaccggcaaccagcaccaggccgagcccaccagcagcaccaacccccugaccgagaaggccguggccagcgugacccuggccggcaacagcagccugugccccaucagaggcugggccauccacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucgccuucaaguacggcaacggcguguggaucggcagaaccaagagcaccaacagcagaagcggcuucgagaugaucugggaccccaacggcuggaccggccccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167509 - RNA, 1350 nt, Artificial Sequence
  derived and/or modified sequence opt4 from neuraminidase__InfluenzaA__ABE97646
augaaccccaaccagaagaucaucaccaucggcagcaucugcauggugaucggcaucgugagccugaugcugcagaucggcaacaugaucagcaucugggugagccacagcauccagaccgagaaccagcaccaggccgagagcaucagcaacaccaacccccccaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacacccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucgugagcaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167510 - RNA, 1350 nt, Artificial Sequence
  derived and/or modified sequence opt4 from neuraminidase__InfluenzaA__ABE97647
augaaccccaaccagaagaucaucaccaucggcagcaucugcauggugaucggcaucgugagccugaugcugcagaucggcaacaugaucagcaucugggugagccacagcauccagaccggcaaccagcacagagccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167511 - RNA, 1350 nt, Artificial Sequence
  derived and/or modified sequence opt4 from neuraminidase__InfluenzaA__ABE97649
augaaccccaaccagaagaucaucaccaucggcagcaucugcauggugaucggcaucgugagccugaugcugcagaucggcaacaugaucagcaucugggugagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167512 - RNA, 1350 nt, Artificial Sequence; identical to SEQ ID NO: 167511
  derived and/or modified sequence opt4 from neuraminidase__InfluenzaA__ABE97651

SEQ ID NO: 167513 - RNA, 1350 nt, Artificial Sequence; identical to SEQ ID NO: 167511
  derived and/or modified sequence opt4 from neuraminidase__InfluenzaA__ABE97653

SEQ ID NO: 167514 - RNA, 1350 nt, Artificial Sequence; identical to SEQ ID NO: 167511
  derived and/or modified sequence opt4 from neuraminidase__InfluenzaA__ABE97654

SEQ ID NO: 167515 - RNA, 1350 nt, Artificial Sequence
  derived and/or modified sequence opt4 from neuraminidase__InfluenzaA__ABE97655
augaaccccaaccagaagaucaucaccaucggcagcaucugcauggccaucggcaucgugagccugaugcugcagaucggcaacaugaucagcaucugggugagccacagcauccagaccggcaaccagcaccaggccgagagcaccagcaacaccaacccccugaccgagaaggccguggccagcgugacccuggccggcaacagcagccugugccccaucagaggcugggccauccacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucgccuucaaguacggcaacggcguguggaucggcagaaccaagagcaccaacagcagaagcggcuucgagaugaucugggaccccaacggcuggaccggccccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167516 - RNA, 1350 nt, Artificial Sequence
  derived and/or modified sequence opt4 from neuraminidase__InfluenzaA__ABE97657
augaaccccaaccagaagaucaucaccaucggcagcaucugcauggugaucggcaccgugagccuggugcugcagaucggcaacaugaucagcaucugggugagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagagacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagcagcaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167517 - RNA, 1350 nt, Artificial Sequence
  derived and/or modified sequence opt4 from neuraminidase__InfluenzaA__ABE97658
augaaccccaaccagaagaucaucaccaucggcagcaucugcauggugaucggcaccaucagccugaugcugcagaucggcaacaugaucagcaucugggugagccacagcauccagaccggcaaccagcaccagaccgagagcaucagcaacaccaacccccugaccgagaaggccguggccagcgugacccuggccggcaacagcagccugugcagcaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagagacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagcagcaacggcgcccacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167518 - RNA, 1350 nt, Artificial Sequence
  derived and/or modified sequence opt4 from neuraminidase__InfluenzaA__ABE97659
augaaccccaaccagaagaucaucaccaucggcagcaucugcauggugaucggcaucgugagccugaugcugcagaucggcaacaugaucagcaucugggugagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacgagaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagagacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagcagcaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167519 - RNA, 1350 nt, Artificial Sequence
  derived and/or modified sequence opt4 from neuraminidase__InfluenzaA__ABE97660
augaaccccaaccagaagaucaucaccaucggcagcaucugcauggugaucggcaccaucagccugaugcugcagaucggcaacaugaucagcaucugggugagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagagacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagcagcaacggcgcccacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167520 - RNA, 1350 nt, Artificial Sequence
  derived and/or modified sequence opt4 from neuraminidase__InfluenzaA__ABE97661
augaaccccaaccagaagaucaucaccaucggcagcaucugcauggugaucggcaccaucagccugaugcugcagaucggcaacaugaucagcaucugggugagccacagcauccagaccggcaaccagcaccagaccgagagcaucagcaacaccaacccccugaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagagacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagcagcaacggcgcccacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaccaccgacuggagcggcuacagcggcagcuucgugcagcaccccgagcugaccggccuggacugcaucagacccugcuucuggguggagcugaucagaggcagacccaaggagagcaccguguggaccagcggcagcagcaucagcuucugcggcgugaacagcgacaccgugagcuggagcuggcccgacggcgccgagcugcccuucaccaucgacaaguga

SEQ ID NO: 167521 - RNA, 1350 nt, Artificial Sequence
  derived and/or modified sequence opt4 from neuraminidase__InfluenzaA__ABE97662
augaaccccaaccagaagaucaucaccaucggcagcaucugcauggugaucggcaucgugagccugaugcugcagaucggcaacaugaucagcaucugggugagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagaugagaaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167522 - RNA, 1350 nt, Artificial Sequence
  derived and/or modified sequence opt4 from neuraminidase__InfluenzaA__ABE97663
augaaccccaaccagaagaucaucaccaucggcagcaucugcauggugaccggcaucgugagccugaugcugcagaucggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucagauacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167523 - RNA, 1350 nt, Artificial Sequence
  derived and/or modified sequence opt4 from neuraminidase__InfluenzaA__ABE97665
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccacggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167524 - RNA, 1350 nt, Artificial Sequence
  derived and/or modified sequence opt4 from neuraminidase__InfluenzaA__ABE97666
augaaccccaaccagaagaucaucaccaucggcagcaucugcauggugaccggcaucgugagccugaugcugcagaucggcaacaugaucagcaucugggugagccacagcauccacaccggcaaccagcaccagagcgagcccaucagcaacaccaacuuccugaccgagaaggccguggccagcgugaagcuggccggcaacagcccccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacagccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167525 - RNA, 1350 nt, Artificial Sequence
  derived and/or modified sequence opt4 from neuraminidase__InfluenzaA__ABE97667
augaaccccaaccagaagaucaucaccaucggcagcaucugcauggugaccggcaucgugagccugaugcugcagaucggcaacaugaucagcaucuggggcagccacagcauccacaccggcaaccagcaccagagcgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccguggugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcaagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaucgugggcuggagcuggcccgacggcgccgagcugcccuucaccaucgacaaguga

SEQ ID NO: 167526 - RNA, 1350 nt, Artificial Sequence
  derived and/or modified sequence opt4 from neuraminidase__InfluenzaA__ABE97669
augaaccccaaccagaagaucaucaccaucggcagcaucugcauggugaccggcaucgugagccugaugcugcagaucggcaacaugaucagcaucugggugagccacagcauccacaccggcaaccagcaccagagcgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccguggugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167527 - RNA, 1350 nt, Artificial Sequence
  derived and/or modified sequence opt4 from neuraminidase__InfluenzaA__ABE97670
augaaccccaaccagaagaucaucaccaucggcagcaucugcauggugaccggcaucgugagccugaugcugcagaucggcaacaugaucagcaucugggugagccacagcauccacaccggcaaccagcaccagagcgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccguggugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacacccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167528 - RNA, 1350 nt, Artificial Sequence
  derived and/or modified sequence opt4 from neuraminidase__InfluenzaA__ABE97671
augaaccccaaccagaagaucaucaccaucggcagcaucugcauggugaccggcaucgugagccugaugcugcagaucggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167529 - RNA, 1350 nt, Artificial Sequence
  derived and/or modified sequence opt4 from neuraminidase__InfluenzaA__ABE97672
augaaccccaaccagaagaucaucaccaucggcagcaucugcauggugaccggcaucgugagccugaugcugcagaucggcaacaugaucagcaucugggugagccacagcauccacaccggcaaccagcaccaggccgagcccaucagcaacaccaacuuccugaccgagaaggcccuggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167530 - RNA, 1350 nt, Artificial Sequence
  derived and/or modified sequence opt4 from neuraminidase__InfluenzaA__ABE97675
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaucgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagaucgagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggagcgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167531 - RNA, 1350 nt, Artificial Sequence
  derived and/or modified sequence opt4 from neuraminidase__InfluenzaA__ABE97676
augaaccccaaccagaagaucaucaccaucggcagcaucugcauggugaccggcaucgugagccugaugcugcagaucggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaacgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167532 - RNA, 1350 nt, Artificial Sequence
  derived and/or modified sequence opt4 from neuraminidase__InfluenzaA__ABE97677
augaaccccaaccagaagaucaucaccaucggcagcaucugcauggugaccggcaucgugagccugaugcugcagaucggcaacaucaucagcaucugggugagacacagcauccacaccggcaaccagcaccagagcgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccguggugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167533 - RNA, 1350 nt, Artificial Sequence
  derived and/or modified sequence opt4 from neuraminidase__InfluenzaA__ABE97679
augaaccccaaccagaagaucaucaccaucggcagcaucugcauggugaccggcaucgugagccugaugcugcagaucggcaacaugaucagcaucugggugagacacagcauccacaccggcaaccagcaccagagcgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccguggugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167534 - RNA, 1350 nt, Artificial Sequence; identical to SEQ ID NO: 167526
  derived and/or modified sequence opt4 from neuraminidase__InfluenzaA__ABE97680

SEQ ID NO: 167535 - RNA, 1350 nt, Artificial Sequence; identical to SEQ ID NO: 167526
  derived and/or modified sequence opt4 from neuraminidase__InfluenzaA__ABE97681

SEQ ID NO: 167536 - RNA, 1350 nt, Artificial Sequence; identical to SEQ ID NO: 167526
  derived and/or modified sequence opt4 from neuraminidase__InfluenzaA__ABE97682

SEQ ID NO: 167537 - RNA, 1350 nt, Artificial Sequence
  derived and/or modified sequence opt4 from neuraminidase__InfluenzaA__ABE97684
augaaccccaaccagaagaucaucaccaucggcagcaucugcauggugaccggcaucgugagccugaugcugcagaucggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcggcaccgugggcuggagcuggcccgacggcgccgagcugcccuucaccaucgacaaguga

SEQ ID NO: 167538 - RNA, 1350 nt, Artificial Sequence
  derived and/or modified sequence opt4 from neuraminidase__InfluenzaA__ABE97685
augaaccccaaccagaagaucaucaccaucggcagcaucugcauggugaccggcaucgugagccugaugcugcagaucggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccggcggcuggagcuggcccgacggcgccgagcugcccuucaccaucgacaaguga

SEQ ID NO: 167539 - RNA, 1350 nt, Artificial Sequence; identical to SEQ ID NO: 167528
  derived and/or modified sequence opt4 from neuraminidase__InfluenzaA__ABE97686

SEQ ID NO: 167540 - RNA, 1350 nt, Artificial Sequence
  derived and/or modified sequence opt4 from neuraminidase__InfluenzaA__ABE97687
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167541 - RNA, 1350 nt, Artificial Sequence
  derived and/or modified sequence opt4 from neuraminidase__InfluenzaA__ABE97688
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaaggugaucaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcgugugggugggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaucaucgacaaguga

SEQ ID NO: 167542 - RNA, 1350 nt, Artificial Sequence
  derived and/or modified sequence opt4 from neuraminidase__InfluenzaA__ABE97690
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaagccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagaugaagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167543 - RNA, 1350 nt, Artificial Sequence
  derived and/or modified sequence opt4 from neuraminidase__InfluenzaA__ABE97691
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaagagagagcccugcaucagcugcagccaccugaagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167544 - RNA, 1350 nt, Artificial Sequence
  derived and/or modified sequence opt4 from neuraminidase__InfluenzaA__ABE97694
augaaccccaaccagaagaucaugaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaccgagaaggccguggacagcgugaagcuggccggcaacagcagccugugccccaucaacggcugggccguguacagcaaggacaacagcaucagaaucggcagcaagggcgacguguucgugaucagagagcccagcgugagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacgugguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167545 - RNA, 1350 nt, Artificial Sequence
  derived and/or modified sequence opt4 from neuraminidase__InfluenzaA__ABE97696
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcagcgugaaggacagaagcccccacagaacccugaugagcugcagcgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167546 - RNA, 1350 nt, Artificial Sequence
  derived and/or modified sequence opt4 from neuraminidase__InfluenzaA__ABE97697
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaacgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacgagaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167547 - RNA, 1350 nt, Artificial Sequence
  derived and/or modified sequence opt4 from neuraminidase__InfluenzaA__ABE97702
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccuacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucgugagcaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaccgacaaguga

SEQ ID NO: 167548 - RNA, 1350 nt, Artificial Sequence; identical to SEQ ID NO: 167540
  derived and/or modified sequence opt4 from neuraminidase__InfluenzaA__ABE97703

SEQ ID NO: 167549 - RNA, 1350 nt, Artificial Sequence; identical to SEQ ID NO: 167540
  derived and/or modified sequence opt4 from neuraminidase__InfluenzaA__ABE97705

SEQ ID NO: 167550 - RNA, 1350 nt, Artificial Sequence
  derived and/or modified sequence opt4 from neuraminidase__InfluenzaA__ABE97706
augaaccccaaccagaagaucaucaccaucggcagcaucugcauggugaccggcaucgugagccugaugcugcaggugggcaacaugaucagccugugggugagccacagcauccacaccggcaaccagcaccaggccgagcccaucagcaacaccaacuuccugaccgagagagccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccagcagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucugggccagcggcagcagcaucagcuucugcggcgugaacagcgacaccgugggcuggagcuggcccgacggcgccgagcugcccuucaccaucgacaaguga

SEQ ID NO: 167551 - RNA, 1350 nt, Artificial Sequence
  derived and/or modified sequence opt4 from neuraminidase__InfluenzaA__ABE97707
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaagggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167552 - RNA, 1350 nt, Artificial Sequence
  derived and/or modified sequence opt4 from neuraminidase__InfluenzaA__ABE97708
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccacggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagaugaagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167553 - RNA, 1350 nt, Artificial Sequence
  derived and/or modified sequence opt4 from neuraminidase__InfluenzaA__ABE97710
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagccugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167554 - RNA, 1350 nt, Artificial Sequence
  derived and/or modified sequence opt4 from neuraminidase__InfluenzaA__ABE97711
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagauggugugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167555 - RNA, 1350 nt, Artificial Sequence; identical to SEQ ID NO: 167540
  derived and/or modified sequence opt4 from neuraminidase__InfluenzaA__ABE97712

SEQ ID NO: 167556 - RNA, 1350 nt, Artificial Sequence; identical to SEQ ID NO: 167540
  derived and/or modified sequence opt4 from neuraminidase__InfluenzaA__ABE97713

SEQ ID NO: 167557 - RNA, 1350 nt, Artificial Sequence; identical to SEQ ID NO: 167540
  derived and/or modified sequence opt4 from neuraminidase__InfluenzaA__ABE97715

SEQ ID NO: 167558 - RNA, 1350 nt, Artificial Sequence
  derived and/or modified sequence opt4 from neuraminidase__InfluenzaA__ABE97717
augaaccccaaccagaagaucaucaccaucggcagcaucugcauggugaccggcaucgugaaccugaugcugcaggugggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugcccagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167559 - RNA, 1350 nt, Artificial Sequence
  derived and/or modified sequence opt4 from neuraminidase__InfluenzaA__ABE97718
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcguggacagcgacaccgugggcuggagcuggcccgacggcgccgagcugcccuucaccaucgacaaguga

SEQ ID NO: 167560 - RNA, 1350 nt, Artificial Sequence
  derived and/or modified sequence opt4 from neuraminidase__InfluenzaA__ABE97719
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagaugaagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167561 - RNA, 1350 nt, Artificial Sequence
  derived and/or modified sequence opt4 from neuraminidase__InfluenzaA__ABE97720
augaaccccaaccagaagaucaucaccaucggcagcaucugcauggugaccggcaucgugagccugaugcugcaggugggcaacaugaucagcaucugggugagccacagcauccacaccggcaaccagcaccaggccgagcccaucagcaacgccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacacccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167562 - RNA, 1410 nt, Artificial Sequence; identical to SEQ ID NO: 167333
  derived and/or modified sequence opt4 from neuraminidase__InfluenzaA__ABF47553

SEQ ID NO: 167563 - RNA, 1413 nt, Artificial Sequence; identical to SEQ ID NO: 166916
  derived and/or modified sequence opt4 from neuraminidase__InfluenzaA__ABF47564

SEQ ID NO: 167564 - RNA, 1413 nt, Artificial Sequence
  derived and/or modified sequence opt4 from neuraminidase__InfluenzaA__ABF47575
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcguggcccuggccggcaacagcagccugugcagcaucagcggcugggccaucuacaccaaggacaacagcaucagaaucggcagcaagggcgacguguucgugaucagagagcccuucaucagcugcagccacuucgagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167565 - RNA, 1413 nt, Artificial Sequence; identical to SEQ ID NO: 166916
  derived and/or modified sequence opt4 from neuraminidase__InfluenzaA__ABF47586

SEQ ID NO: 167566 - RNA, 1410 nt, Artificial Sequence; identical to SEQ ID NO: 166646
  derived and/or modified sequence opt4 from neuraminidase__InfluenzaA__ABF47597

SEQ ID NO: 167567 - RNA, 1413 nt, Artificial Sequence; identical to SEQ ID NO: 167488
  derived and/or modified sequence opt4 from neuraminidase__InfluenzaA__ABF47608

SEQ ID NO: 167568 - RNA, 1410 nt, Artificial Sequence
  derived and/or modified sequence opt4 from neuraminidase__InfluenzaA__ABF47619
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcgccagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167569 - RNA, 1413 nt, Artificial Sequence
  derived and/or modified sequence opt4 from neuraminidase__InfluenzaA__ABF47630
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcauggcccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167570 - RNA, 1413 nt, Artificial Sequence
  derived and/or modified sequence opt4 from neuraminidase__InfluenzaA__ABF47652
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccaacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167571 - RNA, 1413 nt, Artificial Sequence; identical to SEQ ID NO: 167488
  derived and/or modified sequence opt4 from neuraminidase__InfluenzaA__ABF47663

SEQ ID NO: 167572 - RNA, 1413 nt, Artificial Sequence
  derived and/or modified sequence opt4 from neuraminidase__InfluenzaA__ABF47674
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcauccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167573 - RNA, 1413 nt, Artificial Sequence; identical to SEQ ID NO: 167471
  derived and/or modified sequence opt4 from neuraminidase__InfluenzaA__ABF47696

SEQ ID NO: 167574 - RNA, 1413 nt, Artificial Sequence
  derived and/or modified sequence opt4 from neuraminidase__InfluenzaA__ABF47707
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucagcaacaccaacgugguggccggcaagggcaccaccagcaugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagcagauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 167575 - RNA, 1413 nt, Artificial Sequence; identical to SEQ ID NO: 167471
  derived and/or modified sequence opt4 from neuraminidase__InfluenzaA__ABF47718

SEQ ID NO: 167576 - RNA, 1413 nt, Artificial Sequence; identical to SEQ ID NO: 167471
  derived and/or modified sequence opt4 from neuraminidase__InfluenzaA__ABF47729

SEQ ID NO: 167577 - RNA, 1413 nt, Artificial Sequence; identical to SEQ ID NO: 167471
  derived and/or modified sequence opt4 from neuraminidase__InfluenzaA__ABF47740

SEQ ID NO: 167578 - RNA, 1413 nt, Artificial Sequence
  derived and/or modified sequence opt4 from neuraminidase__InfluenzaA__ABF47751
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcaacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgccaacuggagcuggcccgacggcgccgagcugcccuucaccaucgacaaguga

SEQ ID NO: 167579 - RNA, 1413 nt, Artificial Sequence
  derived and/or modified sequence opt4 from neuraminidase__InfluenzaA__ABF47773
augaaccccaaccagaagaucaucaccaucggcagcaucugcaugaccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcaacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgccaacuggagcuggcccgacggcgccgagcugcccuucaccaucgacaaguga

SEQ ID NO: 167580 - RNA, 1413 nt, Artificial Sequence; identical to SEQ ID NO: 167579
  derived and/or modified sequence opt4 from neuraminidase__InfluenzaA__ABF47784

SEQ ID NO: 167581 - RNA, 1413 nt, Artificial Sequence; identical to SEQ ID NO: 167579
  derived and/or modified sequence opt4 from neuraminidase__InfluenzaA__ABF47795

SEQ ID NO: 167582 - RNA, 1413 nt, Artificial Sequence; identical to SEQ ID NO: 167579
  derived and/or modified sequence opt4 from neuraminidase__InfluenzaA__ABF47806

SEQ ID NO: 167583 - RNA, 1413 nt, Artificial Sequence; identical to SEQ ID NO: 167579
  derived and/or modified sequence opt4 from neuraminidase__InfluenzaA__ABF47817

SEQ ID NO: 167584 - RNA, 1413 nt, Artificial Sequence; identical to SEQ ID NO: 167579
  derived and/or modified sequence opt4 from neuraminidase__InfluenzaA__ABF47839

SEQ ID NO: 167585 - RNA, 1413 nt, Artificial Sequence; identical to SEQ ID NO: 167579
  derived and/or modified sequence opt4 from neuraminidase__InfluenzaA__ABF47850

SEQ ID NO: 167586 - RNA, 1413 nt, Artificial Sequence; identical to SEQ ID NO: 167348
  derived and/or modified sequence opt4 from neuraminidase__InfluenzaA__ABF47872

SEQ ID NO: 167587 - RNA, 1413 nt, Artificial Sequence; identical to SEQ ID NO: 167348
  derived and/or modified sequence opt4 from neuraminidase__InfluenzaA__ABF47883

SEQ ID NO: 167588 - RNA, 1413 nt, Artificial Sequence; identical to SEQ ID NO: 167348
  derived and/or modified sequence opt4 from neuraminidase__InfluenzaA__ABF47894

SEQ ID NO: 167589 - RNA, 1410 nt, Artificial Sequence; identical to SEQ ID NO: 167364
  derived and/or modified sequence opt4 from neuraminidase__InfluenzaA__ABF47905

SEQ ID NO: 167590 - RNA, 1362 nt, Artificial Sequence
  derived and/or modified sequence opt4 from neuraminidase__InfluenzaA__ABF47958
augaaccccaaccagaagaucaucaccaucggcagcaucugcaugguggugggcaucaucagccugauccugcagaucggcaacaucaucagcaucuggaucagccacagcauccagaccggcaaccagaaccacaccggcaucugcaaccagggcagcaucaccuacaaggugguggccggccaggacagcaccagcgugauccugaccggcaacagcagccugugccccaucagaggcugggccauccacagcaaggacaacggcaucagaaucggcagcaagggcgacguguucgugaucagagagcccuucaucagcugcagccaccuggagugcagaaccuucuuccugacccagggcgcccugcugaacgacaagcacagcagaggcaccuucaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagaacauccugagaacccaggagagcgagugcaccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuacaagaucggcuacaucugcagcggcguguucggcgacaaccccagacccaaggacggcaccggcagcugcggccccgugagcgccgacggcgccaacggcgugaagggcuucagcuacaaguacggcaacggcguguggaucggcagaaccaagagcgacagcagcagacacggcuucgagaugaucugggaccccaacggcuggaccgagaccgacagcagauucagcaugagacaggacgugguggccaugaccgacagaagcggcuacagcggcagcuucgugcagcaccccgagcugaccggccuggacugcaugagacccugcuucuggguggagcugaucagaggccugcccgaggaggacgccaucuggaccagcggcagcaucaucagcuucugcggcgugaacagcgacaccguggacuggagcuggcccgacggcgccgagcugcccuucaccaucgacaaguga

SEQ ID NO: 167591 - RNA, 1350 nt, Artificial Sequence
  derived and/or modified sequence opt4 from neuraminidase__InfluenzaA__ABF56651
augaaccccaaccagaagaucaucaccaucggcagcaucugcauggugaccggcaucgugagccugaugcugcaggugggcaacaugaucagcaucugggugagccacagcauccacaccggcagccagcaccaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 167592 - RNA, 1410 nt, Artificial Sequence; identical to SEQ ID NO: 167347
  derived and/or modified sequence opt4 from neuraminidase__InfluenzaA__ABF82654

SEQ ID NO: 167593 - RNA, 1413 nt, Artificial Sequence; identical to SEQ ID NO: 166916
  derived and/or modified sequence opt4 from neuraminidase__InfluenzaA__ABF82665

SEQ ID NO: 167594 - RNA, 1413 nt, Artificial Sequence; identical to SEQ ID NO: 166916
  derived and/or modified sequence opt4 from neuraminidase__InfluenzaA__ABF82676

SEQ ID NO: 167595 - RNA, 1413 nt, Artificial Sequence
  derived and/or modified sequence opt4 from neuraminidase__InfluenzaA__ABF82687
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaagaccaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccugaacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167596 - RNA, 1410 nt, Artificial Sequence
  derived and/or modified sequence opt4 from neuraminidase__InfluenzaA__ABF82698
augaaccccaaccagaagaucaucaccaucggcagcgugagccugaccaucaccaccaucugcuuccugaugcagaucgccauccuggugaucaccgugacccugcacuucaagcagugcgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccuggaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacaagggcaacagaagcggcuacagcggcaucuucagcguggagggcaagagcugcaccaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167597 - RNA, 1410 nt, Artificial Sequence; identical to SEQ ID NO: 166646
  derived and/or modified sequence opt4 from neuraminidase__InfluenzaA__ABF82709

SEQ ID NO: 167598 - RNA, 1413 nt, Artificial Sequence; identical to SEQ ID NO: 166935
  derived and/or modified sequence opt4 from neuraminidase__InfluenzaA__ABF82822

SEQ ID NO: 167599 - RNA, 1413 nt, Artificial Sequence; identical to SEQ ID NO: 166916
  derived and/or modified sequence opt4 from neuraminidase__InfluenzaA__ABF82833

SEQ ID NO: 167600 - RNA, 1413 nt, Artificial Sequence; identical to SEQ ID NO: 166916
  derived and/or modified sequence opt4 from neuraminidase__InfluenzaA__ABF82844

SEQ ID NO: 167601 - RNA, 1413 nt, Artificial Sequence
  derived and/or modified sequence opt4 from neuraminidase__InfluenzaA__ABF82855
augaaccccaaccagaagaucaucaccaucggcagcaucagcaucgccaucggcaucaucagccugaugcugcagaucggcaacaucaucagcaucugggccagccacagcauccagaucggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167602 - RNA, 1413 nt, Artificial Sequence; identical to SEQ ID NO: 166916
  derived and/or modified sequence opt4 from neuraminidase__InfluenzaA__ABF82866

SEQ ID NO: 167603 - RNA, 1413 nt, Artificial Sequence; identical to SEQ ID NO: 167450
  derived and/or modified sequence opt4 from neuraminidase__InfluenzaA__ABF82888

SEQ ID NO: 167604 - RNA, 1413 nt, Artificial Sequence; identical to SEQ ID NO: 166916
  derived and/or modified sequence opt4 from neuraminidase__InfluenzaA__ABF82910

SEQ ID NO: 167605 - RNA, 1413 nt, Artificial Sequence; identical to SEQ ID NO: 166916
  derived and/or modified sequence opt4 from neuraminidase__InfluenzaA__ABF82921

SEQ ID NO: 167606 - RNA, 1413 nt, Artificial Sequence; identical to SEQ ID NO: 166916
  derived and/or modified sequence opt4 from neuraminidase__InfluenzaA__ABF82932

SEQ ID NO: 167607 - RNA, 1413 nt, Artificial Sequence; identical to SEQ ID NO: 166916
  derived and/or modified sequence opt4 from neuraminidase__InfluenzaA__ABF82943

SEQ ID NO: 167608 - RNA, 1350 nt, Artificial Sequence
  derived and/or modified sequence opt4 from neuraminidase__InfluenzaA__ABG20474
augaaccccaaccagaagaucaucaccaucggcagcaucugcauggugaucggcaucgugagccugaugcugcagaucggcaacaugaucagcaucugggugagccacagcauccagaccggcaaccagagacaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagccccuacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacgugcugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucuucuucugcggcgugaacagcgacaccgugagcuggagcuggcccgacggcgccgagcugcccuucaccaucgacaaguga

SEQ ID NO: 167609 - RNA, 1410 nt, Artificial Sequence; identical to SEQ ID NO: 166646
  derived and/or modified sequence opt4 from neuraminidase__InfluenzaA__ABG26761

SEQ ID NO: 167610 - RNA, 1410 nt, Artificial Sequence
  derived and/or modified sequence opt4 from neuraminidase__InfluenzaA__ABG26772
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucaaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167611 - RNA, 1413 nt, Artificial Sequence
  derived and/or modified sequence opt4 from neuraminidase__InfluenzaA__ABG26783
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccaacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167612 - RNA, 1413 nt, Artificial Sequence; identical to SEQ ID NO: 167488
  derived and/or modified sequence opt4 from neuraminidase__InfluenzaA__ABG26794

SEQ ID NO: 167613 - RNA, 1410 nt, Artificial Sequence
  derived and/or modified sequence opt4 from neuraminidase__InfluenzaA__ABG26805
augaaccccaaccagaagaucaucaccaucggcagcgugagccugaccaucgccaccaucugcuuccugacccagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaacccccuacagaacccugcugaugaacgagcugggcgugcccuuccaccugggcaccaagcaggugugcaucgccuggagcagcagcagcugccacgacggcaaggccuggcugcacgugugcaucaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacagaucaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167614 - RNA, 1413 nt, Artificial Sequence; identical to SEQ ID NO: 167471
  derived and/or modified sequence opt4 from neuraminidase__InfluenzaA__ABG26816

SEQ ID NO: 167615 - RNA, 1413 nt, Artificial Sequence; identical to SEQ ID NO: 167579
  derived and/or modified sequence opt4 from neuraminidase__InfluenzaA__ABG26827

SEQ ID NO: 167616 - RNA, 1413 nt, Artificial Sequence; identical to SEQ ID NO: 167579
  derived and/or modified sequence opt4 from neuraminidase__InfluenzaA__ABG26838

SEQ ID NO: 167617 - RNA, 1410 nt, Artificial Sequence
  derived and/or modified sequence opt4 from neuraminidase__InfluenzaA__ABG26860
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgacagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucaucgacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagagcagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167618 - RNA, 1410 nt, Artificial Sequence
  derived and/or modified sequence opt4 from neuraminidase__InfluenzaA__ABG26871
augaaccccaaccagaagaucaucaccaucggcagcgugagccugaccaucgccaccaucugcuuccugaugcagaucgccauccuggugaccaccgugacccugcacuucaagcaguacgagugcaacagcccccccuacaaccagaucaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgacagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagagcagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167619 - RNA, 1410 nt, Artificial Sequence
  derived and/or modified sequence opt4 from neuraminidase__InfluenzaA__ABG26893
augaaccccaaccagaagaucaucaccaucggcagcaucagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgacagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagagcagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167620 - RNA, 1410 nt, Artificial Sequence
  derived and/or modified sequence opt4 from neuraminidase__InfluenzaA__ABG26915
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucagcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcgugaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167621 - RNA, 1410 nt, Artificial Sequence
  derived and/or modified sequence opt4 from neuraminidase__InfluenzaA__ABG26937
augaaccccaaccagaagaucaucaccaucggcagcgugagccugaccaucgccaccaucugcuuccugaugcagaucgccauccuggugaccaccgugacccugcacuucaagcaguacgagugcaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167622 - RNA, 1413 nt, Artificial Sequence; identical to SEQ ID NO: 166916
  derived and/or modified sequence opt4 from neuraminidase__InfluenzaA__ABG26948

SEQ ID NO: 167623 - RNA, 1410 nt, Artificial Sequence; identical to SEQ ID NO: 166686
  derived and/or modified sequence opt4 from neuraminidase__InfluenzaA__ABG26959

SEQ ID NO: 167624 - RNA, 1413 nt, Artificial Sequence
  derived and/or modified sequence opt4 from neuraminidase__InfluenzaA__ABG37123
augaaccccaaccagaagaucaucaccaucggcagcaucagcaucaccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167625 - RNA, 1410 nt, Artificial Sequence
  derived and/or modified sequence opt4 from neuraminidase__InfluenzaA__ABG37134
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagccagcugcugggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167626 - RNA, 1410 nt, Artificial Sequence; identical to SEQ ID NO: 166646
  derived and/or modified sequence opt4 from neuraminidase__InfluenzaA__ABG37145

SEQ ID NO: 167627 - RNA, 1410 nt, Artificial Sequence
  derived and/or modified sequence opt4 from neuraminidase__InfluenzaA__ABG37156
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcaacuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167628 - RNA, 1410 nt, Artificial Sequence
  derived and/or modified sequence opt4 from neuraminidase__InfluenzaA__ABG37167
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucagcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcgugaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167629 - RNA, 1410 nt, Artificial Sequence
  derived and/or modified sequence opt4 from neuraminidase__InfluenzaA__ABG37189
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugcugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167630 - RNA, 1410 nt, Artificial Sequence
  derived and/or modified sequence opt4 from neuraminidase__InfluenzaA__ABG37200
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgacagcggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167631 - RNA, 1410 nt, Artificial Sequence
  derived and/or modified sequence opt4 from neuraminidase__InfluenzaA__ABG37211
augaaccccaaccagaagaucaucaccaucggcagcgugagccugaccaucgccaccaucugcuuccugacccagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaacccccuacagaacccugcugaugaacgagcugggcgugcccuuccaccugggcaccaagcaggugugcaucgccuggagcagcagcagcugccacgacggcaaggccuggcugcacgugugcaucaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 167632 - RNA, 1410 nt, Artificial Sequence
  derived and/or modified sequence opt4 from neuraminidase__InfluenzaA__ABG37233
augaaccccaaccagaagaucaucaccaucggcagcgugagccugaccaucgccaccaucugcuuccugaugcagaucgccauccuggugaccaccgugacccugcacuucaagcaguacgagugcaacagcccccccagcaaccaggccaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccaccaucaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcaacagcuacugcagaaaccccaacaacgagaagggcagccacggcgugaagggcugggccuucgacgacggcaacgacguguggaugggcagaaccaucagcgccgagagcagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167633 - RNA, 1410 nt, Artificial Sequence
  derived and/or modified sequence opt4 from neuraminidase__InfluenzaA__ABG37244
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgacagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagagcagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167634 - RNA, 1410 nt, Artificial Sequence; identical to SEQ ID NO: 167633
  derived and/or modified sequence opt4 from neuraminidase__InfluenzaA__ABG37255

SEQ ID NO: 167635 - RNA, 1410 nt, Artificial Sequence; identical to SEQ ID NO: 167620
  derived and/or modified sequence opt4 from neuraminidase__InfluenzaA__ABG37266

SEQ ID NO: 167636 - RNA, 1410 nt, Artificial Sequence; identical to SEQ ID NO: 167633
  derived and/or modified sequence opt4 from neuraminidase__InfluenzaA__ABG37277

SEQ ID NO: 167637 - RNA, 1410 nt, Artificial Sequence; identical to SEQ ID NO: 167633
  derived and/or modified sequence opt4 from neuraminidase__InfluenzaA__ABG37288

SEQ ID NO: 167638 - RNA, 1410 nt, Artificial Sequence; identical to SEQ ID NO: 167633
  derived and/or modified sequence opt4 from neuraminidase__InfluenzaA__ABG37310

SEQ ID NO: 167639 - RNA, 1410 nt, Artificial Sequence; identical to SEQ ID NO: 167620
  derived and/or modified sequence opt4 from neuraminidase__InfluenzaA__ABG37321

SEQ ID NO: 167640 - RNA, 1410 nt, Artificial Sequence
  derived and/or modified sequence opt4 from neuraminidase__InfluenzaA__ABG37332
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucgugcaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgacagagccgacaccaagauccuguucaucgaggagggcaagaucgugcacaucagcccccugagcggcggcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagagcagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167641 - RNA, 1410 nt, Artificial Sequence
  derived and/or modified sequence opt4 from neuraminidase__InfluenzaA__ABG37343
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgacagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaagaacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagagcagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167642 - RNA, 1410 nt, Artificial Sequence; identical to SEQ ID NO: 167621
  derived and/or modified sequence opt4 from neuraminidase__InfluenzaA__ABG37354

SEQ ID NO: 167643 - RNA, 1413 nt, Artificial Sequence; identical to SEQ ID NO: 167348
  derived and/or modified sequence opt4 from neuraminidase__InfluenzaA__ABG37365

SEQ ID NO: 167644 - RNA, 1413 nt, Artificial Sequence; identical to SEQ ID NO: 167450
  derived and/or modified sequence opt4 from neuraminidase__InfluenzaA__ABG37387

SEQ ID NO: 167645 - RNA, 1413 nt, Artificial Sequence
  derived and/or modified sequence opt4 from neuraminidase__InfluenzaA__ABG37398
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacaacaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 167646 - RNA, 1410 nt, Artificial Sequence
  derived and/or modified sequence opt4 from neuraminidase__InfluenzaA__ABG37409
augaaccccaaccagaagaucaucaccaucggcagcgugagccugaccaucgccaccaucugcuuccugaugcagaucgugauccuggugaccaccgugacccugcacuucaagcaguacgagugcaacagcccccccaacaaccaggugaugcccugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacagaaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167647 - RNA, 1410 nt, Artificial Sequence
  derived and/or modified sequence opt4 from neuraminidase__InfluenzaA__ABG37442
augaaccccaaccagaagaucaucaccaucggcagcgugagccugaccaucgccaccaucugcuuccugaugcagaucgccauccuggugaccaccgugacccugcacuucaagcaguucgagugcaacagcccccccaacaaccaggugaugcugugcgagcccaccaucaucgagggcaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167648 - RNA, 1410 nt, Artificial Sequence; identical to SEQ ID NO: 166674
  derived and/or modified sequence opt4 from neuraminidase__InfluenzaA__ABG37453

SEQ ID NO: 167649 - RNA, 1410 nt, Artificial Sequence; identical to SEQ ID NO: 166686
  derived and/or modified sequence opt4 from neuraminidase__InfluenzaA__ABG37464

SEQ ID NO: 167650 - RNA, 1410 nt, Artificial Sequence
  derived and/or modified sequence opt4 from neuraminidase__InfluenzaA__ABG37475
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167651 - RNA, 1410 nt, Artificial Sequence
  derived and/or modified sequence opt4 from neuraminidase__InfluenzaA__ABG37486
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaaccugaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167652 - RNA, 1410 nt, Artificial Sequence
  derived and/or modified sequence opt4 from neuraminidase__InfluenzaA__ABG37497
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagaucaucuucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167653 - RNA, 1410 nt, Artificial Sequence; identical to SEQ ID NO: 166700
  derived and/or modified sequence opt4 from neuraminidase__InfluenzaA__ABG37508

SEQ ID NO: 167654 - RNA, 1410 nt, Artificial Sequence; identical to SEQ ID NO: 167111
  derived and/or modified sequence opt4 from neuraminidase__InfluenzaA__ABG37519

SEQ ID NO: 167655 - RNA, 1410 nt, Artificial Sequence; identical to SEQ ID NO: 167111
  derived and/or modified sequence opt4 from neuraminidase__InfluenzaA__ABG37530

SEQ ID NO: 167656 - RNA, 1410 nt, Artificial Sequence; identical to SEQ ID NO: 167111
  derived and/or modified sequence opt4 from neuraminidase__InfluenzaA__ABG37541

SEQ ID NO: 167657 - RNA, 1410 nt, Artificial Sequence; identical to SEQ ID NO: 167111
  derived and/or modified sequence opt4 from neuraminidase__InfluenzaA__ABG37552

SEQ ID NO: 167658 - RNA, 1410 nt, Artificial Sequence; identical to SEQ ID NO: 167111
  derived and/or modified sequence opt4 from neuraminidase__InfluenzaA__ABG37563

SEQ ID NO: 167659 - RNA, 1410 nt, Artificial Sequence; identical to SEQ ID NO: 167111
  derived and/or modified sequence opt4 from neuraminidase__InfluenzaA__ABG37585

SEQ ID NO: 167660 - RNA, 1410 nt, Artificial Sequence; identical to SEQ ID NO: 167111
  derived and/or modified sequence opt4 from neuraminidase__InfluenzaA__ABG37596

SEQ ID NO: 167661 - RNA, 1410 nt, Artificial Sequence; identical to SEQ ID NO: 167111
  derived and/or modified sequence opt4 from neuraminidase__InfluenzaA__ABG37607

SEQ ID NO: 167662 - RNA, 1410 nt, Artificial Sequence; identical to SEQ ID NO: 167111
  derived and/or modified sequence opt4 from neuraminidase__InfluenzaA__ABG37618

SEQ ID NO: 167663 - RNA, 1413 nt, Artificial Sequence; identical to SEQ ID NO: 167348
  derived and/or modified sequence opt4 from neuraminidase__InfluenzaA__ABG47810

SEQ ID NO: 167664 - RNA, 1413 nt, Artificial Sequence
  derived and/or modified sequence opt4 from neuraminidase__InfluenzaA__ABG47832
augaaccccaaccagaagaucaucaccaucggcagcaucagcaucgccaucggcaucaucagccugauccugcaggugggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccaacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167665 - RNA, 1413 nt, Artificial Sequence; identical to SEQ ID NO: 167488
  derived and/or modified sequence opt4 from neuraminidase__InfluenzaA__ABG47843

SEQ ID NO: 167666 - RNA, 1410 nt, Artificial Sequence
  derived and/or modified sequence opt4 from neuraminidase__InfluenzaA__ABG47865
augaaccccaaccagaagaucaucaccaucggcagcgugagccugaccaucgccaccaucugcuuccugaugcagaucgccauccuggugaucaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauacagcggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167667 - RNA, 1410 nt, Artificial Sequence; identical to SEQ ID NO: 167633
  derived and/or modified sequence opt4 from neuraminidase__InfluenzaA__ABG47876

SEQ ID NO: 167668 - RNA, 1410 nt, Artificial Sequence; identical to SEQ ID NO: 167633
  derived and/or modified sequence opt4 from neuraminidase__InfluenzaA__ABG47887

SEQ ID NO: 167669 - RNA, 1410 nt, Artificial Sequence; identical to SEQ ID NO: 167620
  derived and/or modified sequence opt4 from neuraminidase__InfluenzaA__ABG47898

SEQ ID NO: 167670 - RNA, 1410 nt, Artificial Sequence; identical to SEQ ID NO: 167633
  derived and/or modified sequence opt4 from neuraminidase__InfluenzaA__ABG47909

SEQ ID NO: 167671 - RNA, 1410 nt, Artificial Sequence; identical to SEQ ID NO: 167621
  derived and/or modified sequence opt4 from neuraminidase__InfluenzaA__ABG47920

SEQ ID NO: 167672 - RNA, 1410 nt, Artificial Sequence; identical to SEQ ID NO: 167621
  derived and/or modified sequence opt4 from neuraminidase__InfluenzaA__ABG47931

SEQ ID NO: 167673 - RNA, 1410 nt, Artificial Sequence; identical to SEQ ID NO: 167621
  derived and/or modified sequence opt4 from neuraminidase__InfluenzaA__ABG47942

SEQ ID NO: 167674 - RNA, 1410 nt, Artificial Sequence
  derived and/or modified sequence opt4 from neuraminidase__InfluenzaA__ABG47953
augaaccccaaccagaagaucaucaccaucggcagcgugagccugaccaucgccaccaucugcuuccugaugcagaucgccauccuggugaccaccgugacccugcacuucaagcaguacgagugcaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccaacaucaaccugaugcccaucuga

SEQ ID NO: 167675 - RNA, 1410 nt, Artificial Sequence
  derived and/or modified sequence opt4 from neuraminidase__InfluenzaA__ABG47964
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccagaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167676 - RNA, 1410 nt, Artificial Sequence
  derived and/or modified sequence opt4 from neuraminidase__InfluenzaA__ABG47975
augaaccccaaccagaagaucaucaccaucggcagcgugagccugaccaucgccaccaucugcuuccugaugcagaucgccauccuggugaccaccgugacccugcacuucaagcaguacgagugcaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagagaccccaacaacgagagaggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167677 - RNA, 1410 nt, Artificial Sequence
  derived and/or modified sequence opt4 from neuraminidase__InfluenzaA__ABG47986
augaaccccaaccagaagaucaucaccaucggcagcgugagccugaccaucgccaccaucugcuuccugaugcagaucgccauccuggugaccaccgugacccugcacuucaagcaguacgagugcaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaagcccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167678 - RNA, 1410 nt, Artificial Sequence; identical to SEQ ID NO: 167621
  derived and/or modified sequence opt4 from neuraminidase__InfluenzaA__ABG47997

SEQ ID NO: 167679 - RNA, 1410 nt, Artificial Sequence
  derived and/or modified sequence opt4 from neuraminidase__InfluenzaA__ABG48008
augaaccccaaccagaagaucaucaccaucggcagcgugagccugaccaucgccaccaucugcuuccugaugcagaucgccauccuggugaccaccgugacccugcacuucaagcaguacgagugcaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaagaaacgacagcagcagcagcagcuacugcagaaagcccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167680 - RNA, 1410 nt, Artificial Sequence
  derived and/or modified sequence opt4 from neuraminidase__InfluenzaA__ABG48019
augaaccccaaccagaagaucaucaccaucggcagcgugagccugaccaucgccaccaucugcuuccugaugcagaucgccauccuggugaccaccgugacccugcacuucaagcaguacgagugcaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgccugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167681 - RNA, 1410 nt, Artificial Sequence; identical to SEQ ID NO: 167621
  derived and/or modified sequence opt4 from neuraminidase__InfluenzaA__ABG48030

SEQ ID NO: 167682 - RNA, 1410 nt, Artificial Sequence; identical to SEQ ID NO: 167621
  derived and/or modified sequence opt4 from neuraminidase__InfluenzaA__ABG48041

SEQ ID NO: 167683 - RNA, 1413 nt, Artificial Sequence; identical to SEQ ID NO: 167348
  derived and/or modified sequence opt4 from neuraminidase__InfluenzaA__ABG48052

SEQ ID NO: 167684 - RNA, 1410 nt, Artificial Sequence; identical to SEQ ID NO: 167250
  derived and/or modified sequence opt4 from neuraminidase__InfluenzaA__ABG48063

SEQ ID NO: 167685 - RNA, 1410 nt, Artificial Sequence; identical to SEQ ID NO: 167373
  derived and/or modified sequence opt4 from neuraminidase__InfluenzaA__ABG48074

SEQ ID NO: 167686 - RNA, 1410 nt, Artificial Sequence; identical to SEQ ID NO: 166674
  derived and/or modified sequence opt4 from neuraminidase__InfluenzaA__ABG48085

SEQ ID NO: 167687 - RNA, 1410 nt, Artificial Sequence
  derived and/or modified sequence opt4 from neuraminidase__InfluenzaA__ABG48107
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagacccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167688 - RNA, 1410 nt, Artificial Sequence; identical to SEQ ID NO: 166686
  derived and/or modified sequence opt4 from neuraminidase__InfluenzaA__ABG48118

SEQ ID NO: 167689 - RNA, 1410 nt, Artificial Sequence; identical to SEQ ID NO: 166686
  derived and/or modified sequence opt4 from neuraminidase__InfluenzaA__ABG48129

SEQ ID NO: 167690 - RNA, 1410 nt, Artificial Sequence; identical to SEQ ID NO: 166674
  derived and/or modified sequence opt4 from neuraminidase__InfluenzaA__ABG48140

SEQ ID NO: 167691 - RNA, 1410 nt, Artificial Sequence; identical to SEQ ID NO: 166686
  derived and/or modified sequence opt4 from neuraminidase__InfluenzaA__ABG48151

SEQ ID NO: 167692 - RNA, 1410 nt, Artificial Sequence; identical to SEQ ID NO: 166674
  derived and/or modified sequence opt4 from neuraminidase__InfluenzaA__ABG48173

SEQ ID NO: 167693 - RNA, 1410 nt, Artificial Sequence; identical to SEQ ID NO: 166686
  derived and/or modified sequence opt4 from neuraminidase__InfluenzaA__ABG48184

SEQ ID NO: 167694 - RNA, 1410 nt, Artificial Sequence
  derived and/or modified sequence opt4 from neuraminidase__InfluenzaA__ABG48195
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugcaucgaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167695 - RNA, 1410 nt, Artificial Sequence
  derived and/or modified sequence opt4 from neuraminidase__InfluenzaA__ABG48206
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucaacgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167696 - RNA, 1410 nt, Artificial Sequence; identical to SEQ ID NO: 167111
  derived and/or modified sequence opt4 from neuraminidase__InfluenzaA__ABG48217

SEQ ID NO: 167697 - RNA, 1410 nt, Artificial Sequence; identical to SEQ ID NO: 167111
  derived and/or modified sequence opt4 from neuraminidase__InfluenzaA__ABG48228

SEQ ID NO: 167698 - RNA, 1410 nt, Artificial Sequence; identical to SEQ ID NO: 167695
  derived and/or modified sequence opt4 from neuraminidase__InfluenzaA__ABG48239

SEQ ID NO: 167699 - RNA, 1410 nt, Artificial Sequence; identical to SEQ ID NO: 167111
  derived and/or modified sequence opt4 from neuraminidase__InfluenzaA__ABG48250

SEQ ID NO: 167700 - RNA, 1410 nt, Artificial Sequence
  derived and/or modified sequence opt4 from neuraminidase__InfluenzaA__ABG48272
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167701 - RNA, 1410 nt, Artificial Sequence
  derived and/or modified sequence opt4 from neuraminidase__InfluenzaA__ABG48294
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugauccccugccagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcagaaacauccugagaacccaggagagcgagugcgugugcaucaacggcaccugcaccguggugaugaccgacggcagcgccagcgagagagccgacaccaagauccuguucaucgaggagggcaagguggugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucaucagcagcuacgugugcagcggccuggugggcgacacccccagaagaaacgacagcagcagcagcagcuacugccagaaccccaacaacgagaagggcagccacggcgugaagggcugggccuucgacgacggcaacgacguguggaugggcagaaccaucagcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucgaccugaugcccaucuga

SEQ ID NO: 167702 - RNA, 1410 nt, Artificial Sequence
  derived and/or modified sequence opt4 from neuraminidase__InfluenzaA__ABG48305
augaaccccaaccagaagaucaucaucaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167703 - RNA, 1410 nt, Artificial Sequence
  derived and/or modified sequence opt4 from neuraminidase__InfluenzaA__ABG48316
augaaccccaaccagaagaucaucaccaucggcagcgugagccugaccguggccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167704 - RNA, 1410 nt, Artificial Sequence
  derived and/or modified sequence opt4 from neuraminidase__InfluenzaA__ABG48327
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagcagaggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167705 - RNA, 1410 nt, Artificial Sequence
  derived and/or modified sequence opt4 from neuraminidase__InfluenzaA__ABG48338
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167706 - RNA, 1410 nt, Artificial Sequence; identical to SEQ ID NO: 167705
  derived and/or modified sequence opt4 from neuraminidase__InfluenzaA__ABG48349

SEQ ID NO: 167707 - RNA, 1410 nt, Artificial Sequence
  derived and/or modified sequence opt4 from neuraminidase__InfluenzaA__ABG48360
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugagcgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcaagcugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167708 - RNA, 1410 nt, Artificial Sequence; identical to SEQ ID NO: 167705
  derived and/or modified sequence opt4 from neuraminidase__InfluenzaA__ABG48371

SEQ ID NO: 167709 - RNA, 1410 nt, Artificial Sequence
  derived and/or modified sequence opt4 from neuraminidase__InfluenzaA__ABG67138
augaaccccaaccagaagaucaucaccaucggcagcgugagccugaccaucgccaccaucugcuuccugacccagaucgccauccuggugaccaccgugacccugcacuucaagcaguacgagugcaacagcccccccagcaaccaggugaugcugugcgagcccaccaccaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167710 - RNA, 1410 nt, Artificial Sequence; identical to SEQ ID NO: 166646
  derived and/or modified sequence opt4 from neuraminidase__InfluenzaA__ABG67149

SEQ ID NO: 167711 - RNA, 1410 nt, Artificial Sequence
  derived and/or modified sequence opt4 from neuraminidase__InfluenzaA__ABG67160
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaagcuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcgugaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167712 - RNA, 1410 nt, Artificial Sequence
  derived and/or modified sequence opt4 from neuraminidase__InfluenzaA__ABG67171
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgacagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagagcagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167713 - RNA, 1410 nt, Artificial Sequence; identical to SEQ ID NO: 167633
  derived and/or modified sequence opt4 from neuraminidase__InfluenzaA__ABG67182

SEQ ID NO: 167714 - RNA, 1410 nt, Artificial Sequence
  derived and/or modified sequence opt4 from neuraminidase__InfluenzaA__ABG67193
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaccaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgacagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaagaacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagagcagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167715 - RNA, 1410 nt, Artificial Sequence; identical to SEQ ID NO: 167633
  derived and/or modified sequence opt4 from neuraminidase__InfluenzaA__ABG67204

SEQ ID NO: 167716 - RNA, 1410 nt, Artificial Sequence
  derived and/or modified sequence opt4 from neuraminidase__InfluenzaA__ABG67215
augaaccccaaccagaagaucaucaccaucggcagcgugagccugaccaucgccaccaucugcuuccugaugcagaucgccauccuggugaccaccgugacccugcacuucaagcaguacgagugcaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcggccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167717 - RNA, 1410 nt, Artificial Sequence; identical to SEQ ID NO: 167621
  derived and/or modified sequence opt4 from neuraminidase__InfluenzaA__ABG67226

SEQ ID NO: 167718 - RNA, 1410 nt, Artificial Sequence; identical to SEQ ID NO: 167621
  derived and/or modified sequence opt4 from neuraminidase__InfluenzaA__ABG67248

SEQ ID NO: 167719 - RNA, 1413 nt, Artificial Sequence; identical to SEQ ID NO: 167348
  derived and/or modified sequence opt4 from neuraminidase__InfluenzaA__ABG67480

SEQ ID NO: 167720 - RNA, 1413 nt, Artificial Sequence; identical to SEQ ID NO: 166916
  derived and/or modified sequence opt4 from neuraminidase__InfluenzaA__ABG67494

SEQ ID NO: 167721 - RNA, 1410 nt, Artificial Sequence; identical to SEQ ID NO: 166674
  derived and/or modified sequence opt4 from neuraminidase__InfluenzaA__ABG67505

SEQ ID NO: 167722 - RNA, 1410 nt, Artificial Sequence; identical to SEQ ID NO: 166674
  derived and/or modified sequence opt4 from neuraminidase__InfluenzaA__ABG67516

SEQ ID NO: 167723 - RNA, 1410 nt, Artificial Sequence; identical to SEQ ID NO: 167687
  derived and/or modified sequence opt4 from neuraminidase__InfluenzaA__ABG67527

SEQ ID NO: 167724 - RNA, 1410 nt, Artificial Sequence
  derived and/or modified sequence opt4 from neuraminidase__InfluenzaA__ABG67538
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaccaucgagagaaacaccaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucaucgacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167725 - RNA, 1410 nt, Artificial Sequence
  derived and/or modified sequence opt4 from neuraminidase__InfluenzaA__ABG67549
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaacgaggugugguggaccagcaacagcaucgugguguucugcggcaccagcggcaccuacggcaccggcagcuggcccgacggcgccgacaucaaccugaugcccaucuga

SEQ ID NO: 167726 - RNA, 1410 nt, Artificial Sequence; identical to SEQ ID NO: 167111
  derived and/or modified sequence opt4 from neuraminidase__InfluenzaA__ABG67560

SEQ ID NO: 167727 - RNA, 1410 nt, Artificial Sequence; identical to SEQ ID NO: 167111
  derived and/or modified sequence opt4 from neuraminidase__InfluenzaA__ABG67571

SEQ ID NO: 167728 - RNA, 1410 nt, Artificial Sequence
  derived and/or modified sequence opt4 from neuraminidase__InfluenzaA__ABG67582
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgccaagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167729 - RNA, 1410 nt, Artificial Sequence; identical to SEQ ID NO: 167695
  derived and/or modified sequence opt4 from neuraminidase__InfluenzaA__ABG67593

SEQ ID NO: 167730 - RNA, 1410 nt, Artificial Sequence; identical to SEQ ID NO: 167111
  derived and/or modified sequence opt4 from neuraminidase__InfluenzaA__ABG67604

SEQ ID NO: 167731 - RNA, 1410 nt, Artificial Sequence; identical to SEQ ID NO: 167111
  derived and/or modified sequence opt4 from neuraminidase__InfluenzaA__ABG67615

SEQ ID NO: 167732 - RNA, 1410 nt, Artificial Sequence; identical to SEQ ID NO: 167111
  derived and/or modified sequence opt4 from neuraminidase__InfluenzaA__ABG67626

SEQ ID NO: 167733 - RNA, 1410 nt, Artificial Sequence; identical to SEQ ID NO: 167111
  derived and/or modified sequence opt4 from neuraminidase__InfluenzaA__ABG67637

SEQ ID NO: 167734 - RNA, 1410 nt, Artificial Sequence; identical to SEQ ID NO: 167111
  derived and/or modified sequence opt4 from neuraminidase__InfluenzaA__ABG67648

SEQ ID NO: 167735 - RNA, 1410 nt, Artificial Sequence
  derived and/or modified sequence opt4 from neuraminidase__InfluenzaA__ABG67659
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcagagacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167736 - RNA, 1410 nt, Artificial Sequence
  derived and/or modified sequence opt4 from neuraminidase__InfluenzaA__ABG67670
augaaccccaaccagaagaucaucaccaucggcagcgugagccugaccaucgccaccaucugcuuccugaugcagaucgccauccugaucaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167737 - RNA, 1410 nt, Artificial Sequence; identical to SEQ ID NO: 167250
  derived and/or modified sequence opt4 from neuraminidase__InfluenzaA__ABG79944

SEQ ID NO: 167738 - RNA, 1413 nt, Artificial Sequence; identical to SEQ ID NO: 167579
  derived and/or modified sequence opt4 from neuraminidase__InfluenzaA__ABG79955

SEQ ID NO: 167739 - RNA, 1410 nt, Artificial Sequence
  derived and/or modified sequence opt4 from neuraminidase__InfluenzaA__ABG79966
augaaccccaaccagaagaucaucaccaucggcagcgugagccugaccaucgccaccaucugcuuccugaugcagaucgccauccuggugaccaccgugacccugcacuucaagcaguacgagugcaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccagaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167740 - RNA, 1410 nt, Artificial Sequence
  derived and/or modified sequence opt4 from neuraminidase__InfluenzaA__ABG79977
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggccaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgacagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagagcagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167741 - RNA, 1410 nt, Artificial Sequence; identical to SEQ ID NO: 167633
  derived and/or modified sequence opt4 from neuraminidase__InfluenzaA__ABG79988

SEQ ID NO: 167742 - RNA, 1410 nt, Artificial Sequence; identical to SEQ ID NO: 167633
  derived and/or modified sequence opt4 from neuraminidase__InfluenzaA__ABG79999

SEQ ID NO: 167743 - RNA, 1410 nt, Artificial Sequence
  derived and/or modified sequence opt4 from neuraminidase__InfluenzaA__ABG80010
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggcaagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgacagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagagcagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167744 - RNA, 1410 nt, Artificial Sequence; identical to SEQ ID NO: 167633
  derived and/or modified sequence opt4 from neuraminidase__InfluenzaA__ABG80021

SEQ ID NO: 167745 - RNA, 1410 nt, Artificial Sequence
  derived and/or modified sequence opt4 from neuraminidase__InfluenzaA__ABG80032
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcaucaucuacgacggcagacugguggacagcaucagcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcgugaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167746 - RNA, 1410 nt, Artificial Sequence; identical to SEQ ID NO: 167620
  derived and/or modified sequence opt4 from neuraminidase__InfluenzaA__ABG80043

SEQ ID NO: 167747 - RNA, 1410 nt, Artificial Sequence; identical to SEQ ID NO: 167633
  derived and/or modified sequence opt4 from neuraminidase__InfluenzaA__ABG80054

SEQ ID NO: 167748 - RNA, 1410 nt, Artificial Sequence; identical to SEQ ID NO: 167620
  derived and/or modified sequence opt4 from neuraminidase__InfluenzaA__ABG80065

SEQ ID NO: 167749 - RNA, 1410 nt, Artificial Sequence
  derived and/or modified sequence opt4 from neuraminidase__InfluenzaA__ABG80076
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagaacugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167750 - RNA, 1410 nt, Artificial Sequence
  derived and/or modified sequence opt4 from neuraminidase__InfluenzaA__ABG80087
augaaccccaaccagaagaucaucaccaucggcagcgugagccugaccaucgccaccaucugcuuccugaugcagaucgccgugcuggugaccaccgugacccugcacuucaagcaguacgagugcaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcauggccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167751 - RNA, 1410 nt, Artificial Sequence; identical to SEQ ID NO: 167677
  derived and/or modified sequence opt4 from neuraminidase__InfluenzaA__ABG80098

SEQ ID NO: 167752 - RNA, 1410 nt, Artificial Sequence; identical to SEQ ID NO: 167621
  derived and/or modified sequence opt4 from neuraminidase__InfluenzaA__ABG80109

SEQ ID NO: 167753 - RNA, 1410 nt, Artificial Sequence
  derived and/or modified sequence opt4 from neuraminidase__InfluenzaA__ABG80120
augaaccccaaccagaagaucaucaccaucggcagcgugagccugaccaucgccaccaucugcuuccugaugcagaucgccauccuggugaccaccgugacccugcacuucaagcaguacgagugcaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcaucugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167754 - RNA, 1410 nt, Artificial Sequence
  derived and/or modified sequence opt4 from neuraminidase__InfluenzaA__ABG80131
augaaccccaaccagaagaucaucaccaucggcagcgugagccugaccaucgccaccaucugcuuccugaugcagaucgccaucauggugaccaccgugacccugcacuucaagcaguacgagugcaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167755 - RNA, 1410 nt, Artificial Sequence; identical to SEQ ID NO: 167621
  derived and/or modified sequence opt4 from neuraminidase__InfluenzaA__ABG80142

SEQ ID NO: 167756 - RNA, 1410 nt, Artificial Sequence; identical to SEQ ID NO: 167677
  derived and/or modified sequence opt4 from neuraminidase__InfluenzaA__ABG80153

SEQ ID NO: 167757 - RNA, 1410 nt, Artificial Sequence; identical to SEQ ID NO: 167621
  derived and/or modified sequence opt4 from neuraminidase__InfluenzaA__ABG80164

SEQ ID NO: 167758 - RNA, 1413 nt, Artificial Sequence; identical to SEQ ID NO: 167348
  derived and/or modified sequence opt4 from neuraminidase__InfluenzaA__ABG80186

SEQ ID NO: 167759 - RNA, 1410 nt, Artificial Sequence; identical to SEQ ID NO: 166581
  derived and/or modified sequence opt4 from neuraminidase__InfluenzaA__ABG80197

SEQ ID NO: 167760 - RNA, 1410 nt, Artificial Sequence; identical to SEQ ID NO: 166773
  derived and/or modified sequence opt4 from neuraminidase__InfluenzaA__ABG80219

SEQ ID NO: 167761 - RNA, 1410 nt, Artificial Sequence
  derived and/or modified sequence opt4 from neuraminidase__InfluenzaA__ABG80230
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcgagagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167762 - RNA, 1410 nt, Artificial Sequence; identical to SEQ ID NO: 167111
  derived and/or modified sequence opt4 from neuraminidase__InfluenzaA__ABG80241

SEQ ID NO: 167763 - RNA, 1410 nt, Artificial Sequence; identical to SEQ ID NO: 167111
  derived and/or modified sequence opt4 from neuraminidase__InfluenzaA__ABG80252

SEQ ID NO: 167764 - RNA, 1410 nt, Artificial Sequence; identical to SEQ ID NO: 167695
  derived and/or modified sequence opt4 from neuraminidase__InfluenzaA__ABG80263

SEQ ID NO: 167765 - RNA, 1410 nt, Artificial Sequence; identical to SEQ ID NO: 167256
  derived and/or modified sequence opt4 from neuraminidase__InfluenzaA__ABG80274

SEQ ID NO: 167766 - RNA, 1410 nt, Artificial Sequence; identical to SEQ ID NO: 166847
  derived and/or modified sequence opt4 from neuraminidase__InfluenzaA__ABG80285

SEQ ID NO: 167767 - RNA, 1410 nt, Artificial Sequence; identical to SEQ ID NO: 166847
  derived and/or modified sequence opt4 from neuraminidase__InfluenzaA__ABG80296

SEQ ID NO: 167768 - RNA, 1410 nt, Artificial Sequence; identical to SEQ ID NO: 166847
  derived and/or modified sequence opt4 from neuraminidase__InfluenzaA__ABG80307

SEQ ID NO: 167769 - RNA, 1410 nt, Artificial Sequence; identical to SEQ ID NO: 167234
  derived and/or modified sequence opt4 from neuraminidase__InfluenzaA__ABG80318

SEQ ID NO: 167770 - RNA, 1410 nt, Artificial Sequence; identical to SEQ ID NO: 166847
  derived and/or modified sequence opt4 from neuraminidase__InfluenzaA__ABG80329

SEQ ID NO: 167771 - RNA, 1410 nt, Artificial Sequence; identical to SEQ ID NO: 166847
  derived and/or modified sequence opt4 from neuraminidase__InfluenzaA__ABG80340

SEQ ID NO: 167772 - RNA, 1410 nt, Artificial Sequence; identical to SEQ ID NO: 167705
  derived and/or modified sequence opt4 from neuraminidase__InfluenzaA__ABG80351

SEQ ID NO: 167773 - RNA, 1410 nt, Artificial Sequence
  derived and/or modified sequence opt4 from neuraminidase__InfluenzaA__ABG80373
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167774 - RNA, 1410 nt, Artificial Sequence; identical to SEQ ID NO: 167773
  derived and/or modified sequence opt4 from neuraminidase__InfluenzaA__ABG80384

SEQ ID NO: 167775 - RNA, 1410 nt, Artificial Sequence
  derived and/or modified sequence opt4 from neuraminidase__InfluenzaA__ABG80395
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcaagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacaugagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167776 - RNA, 1410 nt, Artificial Sequence; identical to SEQ ID NO: 167705
  derived and/or modified sequence opt4 from neuraminidase__InfluenzaA__ABG80406

SEQ ID NO: 167777 - RNA, 1410 nt, Artificial Sequence; identical to SEQ ID NO: 167705
  derived and/or modified sequence opt4 from neuraminidase__InfluenzaA__ABG80417

SEQ ID NO: 167778 - RNA, 1410 nt, Artificial Sequence; identical to SEQ ID NO: 167705
  derived and/or modified sequence opt4 from neuraminidase__InfluenzaA__ABG80428

SEQ ID NO: 167779 - RNA, 1410 nt, Artificial Sequence; identical to SEQ ID NO: 166646
  derived and/or modified sequence opt4 from neuraminidase__InfluenzaA__ABG88292

SEQ ID NO: 167780 - RNA, 1413 nt, Artificial Sequence; identical to SEQ ID NO: 167570
  derived and/or modified sequence opt4 from neuraminidase__InfluenzaA__ABG88314

SEQ ID NO: 167781 - RNA, 1413 nt, Artificial Sequence
  derived and/or modified sequence opt4 from neuraminidase__InfluenzaA__ABG88325
augaaccccaaccagaagaucaucaccaucggcagcaccagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccagcgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaccggcuacaucugcagcggcguguucggcgacaaccccagacccaaggacggcgagggcagcugcaaccccgugaccgccgacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167782 - RNA, 1413 nt, Artificial Sequence
  derived and/or modified sequence opt4 from neuraminidase__InfluenzaA__ABG88336
augaaccccaaccagaagaucaucaccaucggcagcaucugcauggccaucggcaucaucagccugauccugcagaucggcaacaucaucagcaucugggugagccacagcauccagaccggcaaccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccgugagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcaacggccccgccagcuacaagaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagcugggcuacaucugcagcggcaucuucggcgacaaccccagacccaaggacggcaagggcagcugcggccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaccaccaccaucuggaccagcggcagcagcaucagcuucugcggcgugaacagcgacaccgugaacuggagcuggcccgacggcgccgagcugcccuucaccaucgacaaguga

SEQ ID NO: 167783 - RNA, 1413 nt, Artificial Sequence
  derived and/or modified sequence opt4 from neuraminidase__InfluenzaA__ABG88347
augaaccccaaccagaagaucaucaccaucggcagcaucugcauggccaucggcaucaucggccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccgugagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcaacggccccgccagcuacaagaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagcugggcuacaucugcagcggcaucuucggcgacaaccccagacccaaggacggcaagggcagcugcggccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaccaccaccaucuggaccagcggcagcagcaucagcuucugcggcgugaacagcgacaccgugaacuggagcuggcccgacggcgccgagcugcccuucaccaucgacaaguga

SEQ ID NO: 167784 - RNA, 1410 nt, Artificial Sequence
  derived and/or modified sequence opt4 from neuraminidase__InfluenzaA__ABG88358
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgacagagccgacaccaagauccuguucaucgaggagggcaagaucgugcacaucagaccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagagcagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167785 - RNA, 1410 nt, Artificial Sequence; identical to SEQ ID NO: 167633
  derived and/or modified sequence opt4 from neuraminidase__InfluenzaA__ABG88369

SEQ ID NO: 167786 - RNA, 1410 nt, Artificial Sequence; identical to SEQ ID NO: 167633
  derived and/or modified sequence opt4 from neuraminidase__InfluenzaA__ABG88380

SEQ ID NO: 167787 - RNA, 1410 nt, Artificial Sequence; identical to SEQ ID NO: 167633
  derived and/or modified sequence opt4 from neuraminidase__InfluenzaA__ABG88391

SEQ ID NO: 167788 - RNA, 1410 nt, Artificial Sequence; identical to SEQ ID NO: 167620
  derived and/or modified sequence opt4 from neuraminidase__InfluenzaA__ABG88402

SEQ ID NO: 167789 - RNA, 1410 nt, Artificial Sequence; identical to SEQ ID NO: 167677
  derived and/or modified sequence opt4 from neuraminidase__InfluenzaA__ABG88413

SEQ ID NO: 167790 - RNA, 1410 nt, Artificial Sequence; identical to SEQ ID NO: 167621
  derived and/or modified sequence opt4 from neuraminidase__InfluenzaA__ABG88424

SEQ ID NO: 167791 - RNA, 1410 nt, Artificial Sequence; identical to SEQ ID NO: 167621
  derived and/or modified sequence opt4 from neuraminidase__InfluenzaA__ABG88435

SEQ ID NO: 167792 - RNA, 1410 nt, Artificial Sequence; identical to SEQ ID NO: 167621
  derived and/or modified sequence opt4 from neuraminidase__InfluenzaA__ABG88446

SEQ ID NO: 167793 - RNA, 1410 nt, Artificial Sequence
  derived and/or modified sequence opt4 from neuraminidase__InfluenzaA__ABG88457
augaaccccaaccagaagaucaucaccaucggcagcgugagccugaccaccgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucaaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccagaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167794 - RNA, 1410 nt, Artificial Sequence; identical to SEQ ID NO: 167621
  derived and/or modified sequence opt4 from neuraminidase__InfluenzaA__ABG88468

SEQ ID NO: 167795 - RNA, 1410 nt, Artificial Sequence; identical to SEQ ID NO: 167621
  derived and/or modified sequence opt4 from neuraminidase__InfluenzaA__ABG88479

SEQ ID NO: 167796 - RNA, 1410 nt, Artificial Sequence; identical to SEQ ID NO: 167621
  derived and/or modified sequence opt4 from neuraminidase__InfluenzaA__ABG88490

SEQ ID NO: 167797 - RNA, 1410 nt, Artificial Sequence; identical to SEQ ID NO: 167621
  derived and/or modified sequence opt4 from neuraminidase__InfluenzaA__ABG88501

SEQ ID NO: 167798 - RNA, 1410 nt, Artificial Sequence; identical to SEQ ID NO: 167621
  derived and/or modified sequence opt4 from neuraminidase__InfluenzaA__ABG88512

SEQ ID NO: 167799 - RNA, 1410 nt, Artificial Sequence; identical to SEQ ID NO: 167621
  derived and/or modified sequence opt4 from neuraminidase__InfluenzaA__ABG88523

SEQ ID NO: 167800 - RNA, 1410 nt, Artificial Sequence
  derived and/or modified sequence opt4 from neuraminidase__InfluenzaA__ABG88534
augaaccccaaccagaagaucaucaccaucggcagcgugagccugaccaucgccaccaucugcuuccugaugcagaucgccauccuggugaccaccgugacccugcacuucaagcaguacgagugcaacagcccccccagcaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagaacaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167801 - RNA, 1410 nt, Artificial Sequence; identical to SEQ ID NO: 167313
  derived and/or modified sequence opt4 from neuraminidase__InfluenzaA__ABG88567

SEQ ID NO: 167802 - RNA, 1410 nt, Artificial Sequence
  derived and/or modified sequence opt4 from neuraminidase__InfluenzaA__ABG88600
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167803 - RNA, 1410 nt, Artificial Sequence; identical to SEQ ID NO: 166674
  derived and/or modified sequence opt4 from neuraminidase__InfluenzaA__ABG88611

SEQ ID NO: 167804 - RNA, 1410 nt, Artificial Sequence; identical to SEQ ID NO: 166686
  derived and/or modified sequence opt4 from neuraminidase__InfluenzaA__ABG88622

SEQ ID NO: 167805 - RNA, 1410 nt, Artificial Sequence; identical to SEQ ID NO: 166674
  derived and/or modified sequence opt4 from neuraminidase__InfluenzaA__ABG88633

SEQ ID NO: 167806 - RNA, 1410 nt, Artificial Sequence; identical to SEQ ID NO: 167725
  derived and/or modified sequence opt4 from neuraminidase__InfluenzaA__ABG88655

SEQ ID NO: 167807 - RNA, 1410 nt, Artificial Sequence; identical to SEQ ID NO: 167725
  derived and/or modified sequence opt4 from neuraminidase__InfluenzaA__ABG88666

SEQ ID NO: 167808 - RNA, 1410 nt, Artificial Sequence; identical to SEQ ID NO: 167111
  derived and/or modified sequence opt4 from neuraminidase__InfluenzaA__ABG88677

SEQ ID NO: 167809 - RNA, 1410 nt, Artificial Sequence; identical to SEQ ID NO: 167725
  derived and/or modified sequence opt4 from neuraminidase__InfluenzaA__ABG88688

SEQ ID NO: 167810 - RNA, 1410 nt, Artificial Sequence; identical to SEQ ID NO: 167111
  derived and/or modified sequence opt4 from neuraminidase__InfluenzaA__ABG88699

SEQ ID NO: 167811 - RNA, 1410 nt, Artificial Sequence; identical to SEQ ID NO: 166847
  derived and/or modified sequence opt4 from neuraminidase__InfluenzaA__ABG88710

SEQ ID NO: 167812 - RNA, 1410 nt, Artificial Sequence; identical to SEQ ID NO: 166847
  derived and/or modified sequence opt4 from neuraminidase__InfluenzaA__ABG88721

SEQ ID NO: 167813 - RNA, 1410 nt, Artificial Sequence
  derived and/or modified sequence opt4 from neuraminidase__InfluenzaA__ABG88732
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167814 - RNA, 1410 nt, Artificial Sequence; identical to SEQ ID NO: 167773
  derived and/or modified sequence opt4 from neuraminidase__InfluenzaA__ABG88743

SEQ ID NO: 167815 - RNA, 1410 nt, Artificial Sequence; identical to SEQ ID NO: 167773
  derived and/or modified sequence opt4 from neuraminidase__InfluenzaA__ABG88754

SEQ ID NO: 167816 - RNA, 1410 nt, Artificial Sequence; identical to SEQ ID NO: 167039
  derived and/or modified sequence opt4 from neuraminidase__InfluenzaA__ABG88765

SEQ ID NO: 167817 - RNA, 1410 nt, Artificial Sequence; identical to SEQ ID NO: 167705
  derived and/or modified sequence opt4 from neuraminidase__InfluenzaA__ABG88776

SEQ ID NO: 167818 - RNA, 1410 nt, Artificial Sequence; identical to SEQ ID NO: 167705
  derived and/or modified sequence opt4 from neuraminidase__InfluenzaA__ABG88787

SEQ ID NO: 167819 - RNA, 1410 nt, Artificial Sequence
  derived and/or modified sequence opt4 from neuraminidase__InfluenzaA__ABG88820
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaagugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167820 - RNA, 1350 nt, Artificial Sequence
  derived and/or modified sequence opt4 from neuraminidase__InfluenzaA__ABI16506
augaaccccaaccagaagaucaucaccaucggcagcaucugcauggugaucggcaucgugagccugaugcugcagaucggcaacauggugagccugugggugagccacagcauccagaccggcaaccagcaccagguggagcccaucagcaacaccaacuuccugaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaugaucaccgacaccaucaagagcuggagaaacaacauccugagaacccaggagagcgagugcgugugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagccccagcagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167821 - RNA, 1413 nt, Artificial Sequence; identical to SEQ ID NO: 167485
  derived and/or modified sequence opt4 from neuraminidase__InfluenzaA__ABI20840

SEQ ID NO: 167822 - RNA, 1413 nt, Artificial Sequence
  derived and/or modified sequence opt4 from neuraminidase__InfluenzaA__ABI20862
augaaccccaaccagaagaucaucaccaucggcagcaucugcaugaccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcaacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaccggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgccaacuggagcuggcccgacggcgccgagcugcccuucaccaucgacaaguga

SEQ ID NO: 167823 - RNA, 1413 nt, Artificial Sequence
  derived and/or modified sequence opt4 from neuraminidase__InfluenzaA__ABI20873
augaaccccaaccagaagaucaucaccaucggcagcaucagcauggccaucggcaucaucagccugacccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccgagaaggacaagaccagcgugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccaccgccugccacgacggcaucggcuggcugaccaucggcaucagcggccccgacaacggcgccguggccgugcugaaguacaacggcgugaucaccgagaccaucaagagcuggaagaagcagauccugagaacccaggagagcgagugcgugugcgugaacggcagcugcuucaccaucaugaccgacggccccagcaacggcgccgccagcuacagaaucuucaagaucgagaagggcaagaucaccaagagcaucgagcuggacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaucaucugggaccccaacggcuggaccgacaccgacagcgacuucagcgugaagcaggacgugguggccaugaccgacuggagcggcuacagcggcagcuucgugcagcaccccgagcugaccggccuggacugcaugagacccugcuucuggguggagcuggugagaggccugcccagagagaacgccaccaucuggaccagcggcagcagcaucagcuucugcggcgugaacagcgacaccgccaacuggagcuggcccgacggcgccgagcugcccuucaccaucgacaaguga

SEQ ID NO: 167824 - RNA, 1410 nt, Artificial Sequence; identical to SEQ ID NO: 167620
  derived and/or modified sequence opt4 from neuraminidase__InfluenzaA__ABI20895

SEQ ID NO: 167825 - RNA, 1410 nt, Artificial Sequence; identical to SEQ ID NO: 167633
  derived and/or modified sequence opt4 from neuraminidase__InfluenzaA__ABI20906

SEQ ID NO: 167826 - RNA, 1410 nt, Artificial Sequence; identical to SEQ ID NO: 167621
  derived and/or modified sequence opt4 from neuraminidase__InfluenzaA__ABI20928

SEQ ID NO: 167827 - RNA, 1410 nt, Artificial Sequence; identical to SEQ ID NO: 167621
  derived and/or modified sequence opt4 from neuraminidase__InfluenzaA__ABI20939

SEQ ID NO: 167828 - RNA, 1410 nt, Artificial Sequence; identical to SEQ ID NO: 167621
  derived and/or modified sequence opt4 from neuraminidase__InfluenzaA__ABI20950

SEQ ID NO: 167829 - RNA, 1410 nt, Artificial Sequence; identical to SEQ ID NO: 167621
  derived and/or modified sequence opt4 from neuraminidase__InfluenzaA__ABI20961

SEQ ID NO: 167830 - RNA, 1410 nt, Artificial Sequence; identical to SEQ ID NO: 167347
  derived and/or modified sequence opt4 from neuraminidase__InfluenzaA__ABI20983

SEQ ID NO: 167831 - RNA, 1410 nt, Artificial Sequence
  derived and/or modified sequence opt4 from neuraminidase__InfluenzaA__ABI20994
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacaacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167832 - RNA, 1410 nt, Artificial Sequence
  derived and/or modified sequence opt4 from neuraminidase__InfluenzaA__ABI21005
augaaccccaaccagaagaucaucaccaucggcagcgugagccugaccaucgccaccaucugcuuccugaugcagaucgccgugcuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacuggccgacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167833 - RNA, 1410 nt, Artificial Sequence; identical to SEQ ID NO: 166674
  derived and/or modified sequence opt4 from neuraminidase__InfluenzaA__ABI21016

SEQ ID NO: 167834 - RNA, 1410 nt, Artificial Sequence
  derived and/or modified sequence opt4 from neuraminidase__InfluenzaA__ABI21027
augaaccccaaccagagaaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcacccccggcaccuacggcaccggcagcuggcccgacggcgccgacaucaaccugaugcccaucuga

SEQ ID NO: 167835 - RNA, 1410 nt, Artificial Sequence; identical to SEQ ID NO: 167111
  derived and/or modified sequence opt4 from neuraminidase__InfluenzaA__ABI21038

SEQ ID NO: 167836 - RNA, 1410 nt, Artificial Sequence
  derived and/or modified sequence opt4 from neuraminidase__InfluenzaA__ABI21049
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcggcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167837 - RNA, 1410 nt, Artificial Sequence
  derived and/or modified sequence opt4 from neuraminidase__InfluenzaA__ABI21060
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcccguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167838 - RNA, 1410 nt, Artificial Sequence
  derived and/or modified sequence opt4 from neuraminidase__InfluenzaA__ABI21071
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugagcgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167839 - RNA, 1410 nt, Artificial Sequence
  derived and/or modified sequence opt4 from neuraminidase__InfluenzaA__ABI21082
augaaccccaaccagaagaucaucaccaucggcagcgugagccugaccaucagcaccaucugcuucuucaugcagaucgccacccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167840 - RNA, 1410 nt, Artificial Sequence; identical to SEQ ID NO: 167256
  derived and/or modified sequence opt4 from neuraminidase__InfluenzaA__ABI21093

SEQ ID NO: 167841 - RNA, 1410 nt, Artificial Sequence
  derived and/or modified sequence opt4 from neuraminidase__InfluenzaA__ABI21104
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccuggccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagaacugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167842 - RNA, 1410 nt, Artificial Sequence; identical to SEQ ID NO: 166847
  derived and/or modified sequence opt4 from neuraminidase__InfluenzaA__ABI21115

SEQ ID NO: 167843 - RNA, 1410 nt, Artificial Sequence; identical to SEQ ID NO: 166847
  derived and/or modified sequence opt4 from neuraminidase__InfluenzaA__ABI21126

SEQ ID NO: 167844 - RNA, 1410 nt, Artificial Sequence; identical to SEQ ID NO: 167256
  derived and/or modified sequence opt4 from neuraminidase__InfluenzaA__ABI21137

SEQ ID NO: 167845 - RNA, 1410 nt, Artificial Sequence; identical to SEQ ID NO: 166847
  derived and/or modified sequence opt4 from neuraminidase__InfluenzaA__ABI21148

SEQ ID NO: 167846 - RNA, 1410 nt, Artificial Sequence
  derived and/or modified sequence opt4 from neuraminidase__InfluenzaA__ABI21159
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcggcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167847 - RNA, 1410 nt, Artificial Sequence; identical to SEQ ID NO: 166847
  derived and/or modified sequence opt4 from neuraminidase__InfluenzaA__ABI21170

SEQ ID NO: 167848 - RNA, 1410 nt, Artificial Sequence; identical to SEQ ID NO: 166847
  derived and/or modified sequence opt4 from neuraminidase__InfluenzaA__ABI21181

SEQ ID NO: 167849 - RNA, 1413 nt, Artificial Sequence
  derived and/or modified sequence opt4 from neuraminidase__InfluenzaA__ABI21192
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaccugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaucaucgacaaguga

SEQ ID NO: 167850 - RNA, 1413 nt, Artificial Sequence; identical to SEQ ID NO: 166906
  derived and/or modified sequence opt4 from neuraminidase__InfluenzaA__ABI21203

SEQ ID NO: 167851 - RNA, 1413 nt, Artificial Sequence
  derived and/or modified sequence opt4 from neuraminidase__InfluenzaA__ABI21214
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaucaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 167852 - RNA, 1410 nt, Artificial Sequence
  derived and/or modified sequence opt4 from neuraminidase__InfluenzaA__ABI21247
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaagugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcagcagcagcagcuacugcagaaaccccaacaacgagaagggcagccacggcaugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167853 - RNA, 1410 nt, Artificial Sequence; identical to SEQ ID NO: 167773
  derived and/or modified sequence opt4 from neuraminidase__InfluenzaA__ABI21258

SEQ ID NO: 167854 - RNA, 1410 nt, Artificial Sequence; identical to SEQ ID NO: 167773
  derived and/or modified sequence opt4 from neuraminidase__InfluenzaA__ABI21269

SEQ ID NO: 167855 - RNA, 1410 nt, Artificial Sequence; identical to SEQ ID NO: 167773
  derived and/or modified sequence opt4 from neuraminidase__InfluenzaA__ABI21280

SEQ ID NO: 167856 - RNA, 1410 nt, Artificial Sequence; identical to SEQ ID NO: 167705
  derived and/or modified sequence opt4 from neuraminidase__InfluenzaA__ABI21302

SEQ ID NO: 167857 - RNA, 1410 nt, Artificial Sequence; identical to SEQ ID NO: 167705
  derived and/or modified sequence opt4 from neuraminidase__InfluenzaA__ABI21313

SEQ ID NO: 167858 - RNA, 1410 nt, Artificial Sequence; identical to SEQ ID NO: 167705
  derived and/or modified sequence opt4 from neuraminidase__InfluenzaA__ABI21324

SEQ ID NO: 167859 - RNA, 1410 nt, Artificial Sequence; identical to SEQ ID NO: 167705
  derived and/or modified sequence opt4 from neuraminidase__InfluenzaA__ABI21335

SEQ ID NO: 167860 - RNA, 1410 nt, Artificial Sequence; identical to SEQ ID NO: 167773
  derived and/or modified sequence opt4 from neuraminidase__InfluenzaA__ABI21346

SEQ ID NO: 167861 - RNA, 1410 nt, Artificial Sequence
  derived and/or modified sequence opt4 from neuraminidase__InfluenzaA__ABI21357
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaagaacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggaggccgaggugugguggaccagcaacagcaucgugguguucugcggcaccagcggcaccuacggcaccggcagcuggcccgacggcgccgacaucaaccugaugcccaucuga

SEQ ID NO: 167862 - RNA, 1410 nt, Artificial Sequence; identical to SEQ ID NO: 167705
  derived and/or modified sequence opt4 from neuraminidase__InfluenzaA__ABI21368

SEQ ID NO: 167863 - RNA, 1410 nt, Artificial Sequence; identical to SEQ ID NO: 167705
  derived and/or modified sequence opt4 from neuraminidase__InfluenzaA__ABI21379

SEQ ID NO: 167864 - RNA, 1410 nt, Artificial Sequence; identical to SEQ ID NO: 167705
  derived and/or modified sequence opt4 from neuraminidase__InfluenzaA__ABI21390

SEQ ID NO: 167865 - RNA, 1410 nt, Artificial Sequence; identical to SEQ ID NO: 167773
  derived and/or modified sequence opt4 from neuraminidase__InfluenzaA__ABI21401

SEQ ID NO: 167866 - RNA, 1410 nt, Artificial Sequence
  derived and/or modified sequence opt4 from neuraminidase__InfluenzaA__ABI21412
augaaccccaaccagaagaucaucaccaucggcagcgugagccugaccaucgccaccaucugcuuccugaugcagaucgccauccuggugaccaccgugacccugcacuucaagcaguacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167867 - RNA, 1410 nt, Artificial Sequence; identical to SEQ ID NO: 167039
  derived and/or modified sequence opt4 from neuraminidase__InfluenzaA__ABI21423

SEQ ID NO: 167868 - RNA, 1410 nt, Artificial Sequence; identical to SEQ ID NO: 167705
  derived and/or modified sequence opt4 from neuraminidase__InfluenzaA__ABI21434

SEQ ID NO: 167869 - RNA, 1410 nt, Artificial Sequence; identical to SEQ ID NO: 167773
  derived and/or modified sequence opt4 from neuraminidase__InfluenzaA__ABI21445

SEQ ID NO: 167870 - RNA, 1410 nt, Artificial Sequence; identical to SEQ ID NO: 167773
  derived and/or modified sequence opt4 from neuraminidase__InfluenzaA__ABI21456

SEQ ID NO: 167871 - RNA, 1410 nt, Artificial Sequence; identical to SEQ ID NO: 167866
  derived and/or modified sequence opt4 from neuraminidase__InfluenzaA__ABI21467

SEQ ID NO: 167872 - RNA, 1410 nt, Artificial Sequence; identical to SEQ ID NO: 167773
  derived and/or modified sequence opt4 from neuraminidase__InfluenzaA__ABI21478

SEQ ID NO: 167873 - RNA, 1410 nt, Artificial Sequence; identical to SEQ ID NO: 167773
  derived and/or modified sequence opt4 from neuraminidase__InfluenzaA__ABI21489

SEQ ID NO: 167874 - RNA, 1410 nt, Artificial Sequence; identical to SEQ ID NO: 167773
  derived and/or modified sequence opt4 from neuraminidase__InfluenzaA__ABI21500

SEQ ID NO: 167875 - RNA, 1410 nt, Artificial Sequence
  derived and/or modified sequence opt4 from neuraminidase__InfluenzaA__ABI21511
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccgccaucaucgagagaaacaucaccgagaucguguaccugaccaacaccaccaucgagaaggagaugugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugaacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167876 - RNA, 1413 nt, Artificial Sequence
  derived and/or modified sequence opt4 from neuraminidase__InfluenzaA__ABI21533
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaugagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaucaagagcaucgagcugaacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167877 - RNA, 1413 nt, Artificial Sequence; identical to SEQ ID NO: 167876
  derived and/or modified sequence opt4 from neuraminidase__InfluenzaA__ABI21544

SEQ ID NO: 167878 - RNA, 1413 nt, Artificial Sequence; identical to SEQ ID NO: 167876
  derived and/or modified sequence opt4 from neuraminidase__InfluenzaA__ABI21555

SEQ ID NO: 167879 - RNA, 1413 nt, Artificial Sequence; identical to SEQ ID NO: 167876
  derived and/or modified sequence opt4 from neuraminidase__InfluenzaA__ABI21566

SEQ ID NO: 167880 - RNA, 1413 nt, Artificial Sequence; identical to SEQ ID NO: 167876
  derived and/or modified sequence opt4 from neuraminidase__InfluenzaA__ABI21577

SEQ ID NO: 167881 - RNA, 1413 nt, Artificial Sequence
  derived and/or modified sequence opt4 from neuraminidase__InfluenzaA__ABI22112
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacgagaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 167882 - RNA, 1410 nt, Artificial Sequence
  derived and/or modified sequence opt4 from neuraminidase__InfluenzaA__ABI22162
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucgaccugaugcccaucuga

SEQ ID NO: 167883 - RNA, 1350 nt, Artificial Sequence
  derived and/or modified sequence opt4 from neuraminidase__InfluenzaA__ABI23981
augaaccccaaccagaagaucaucaccaucggcagcaucugcauggugaucggcaucgugagccugaugcugcagaucggcaacaugaucagcaucugggugagccacagcauccagaccggcaaccagagacaggccgagagcaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagccccuacagaacccugaugagcagccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccugaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167884 - RNA, 1410 nt, Artificial Sequence; identical to SEQ ID NO: 166847
  derived and/or modified sequence opt4 from neuraminidase__InfluenzaA__ABI26649

SEQ ID NO: 167885 - RNA, 1413 nt, Artificial Sequence; identical to SEQ ID NO: 167570
  derived and/or modified sequence opt4 from neuraminidase__InfluenzaA__ABI30370

SEQ ID NO: 167886 - RNA, 1410 nt, Artificial Sequence; identical to SEQ ID NO: 167621
  derived and/or modified sequence opt4 from neuraminidase__InfluenzaA__ABI30392

SEQ ID NO: 167887 - RNA, 1410 nt, Artificial Sequence; identical to SEQ ID NO: 167250
  derived and/or modified sequence opt4 from neuraminidase__InfluenzaA__ABI30403

SEQ ID NO: 167888 - RNA, 1410 nt, Artificial Sequence; identical to SEQ ID NO: 167250
  derived and/or modified sequence opt4 from neuraminidase__InfluenzaA__ABI30414

SEQ ID NO: 167889 - RNA, 1410 nt, Artificial Sequence; identical to SEQ ID NO: 166847
  derived and/or modified sequence opt4 from neuraminidase__InfluenzaA__ABI30425

SEQ ID NO: 167890 - RNA, 1410 nt, Artificial Sequence; identical to SEQ ID NO: 166847
  derived and/or modified sequence opt4 from neuraminidase__InfluenzaA__ABI30436

SEQ ID NO: 167891 - RNA, 1410 nt, Artificial Sequence; identical to SEQ ID NO: 166847
  derived and/or modified sequence opt4 from neuraminidase__InfluenzaA__ABI30447

SEQ ID NO: 167892 - RNA, 1410 nt, Artificial Sequence; identical to SEQ ID NO: 166847
  derived and/or modified sequence opt4 from neuraminidase__InfluenzaA__ABI30458

SEQ ID NO: 167893 - RNA, 1410 nt, Artificial Sequence; identical to SEQ ID NO: 166847
  derived and/or modified sequence opt4 from neuraminidase__InfluenzaA__ABI30469

SEQ ID NO: 167894 - RNA, 1410 nt, Artificial Sequence; identical to SEQ ID NO: 166847
  derived and/or modified sequence opt4 from neuraminidase__InfluenzaA__ABI30480

SEQ ID NO: 167895 - RNA, 1410 nt, Artificial Sequence
  derived and/or modified sequence opt4 from neuraminidase__InfluenzaA__ABI30491
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccaagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167896 - RNA, 1410 nt, Artificial Sequence; identical to SEQ ID NO: 166847
  derived and/or modified sequence opt4 from neuraminidase__InfluenzaA__ABI30502

SEQ ID NO: 167897 - RNA, 1410 nt, Artificial Sequence
  derived and/or modified sequence opt4 from neuraminidase__InfluenzaA__ABI30513
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167898 - RNA, 1410 nt, Artificial Sequence; identical to SEQ ID NO: 166847
  derived and/or modified sequence opt4 from neuraminidase__InfluenzaA__ABI30524

SEQ ID NO: 167899 - RNA, 1410 nt, Artificial Sequence; identical to SEQ ID NO: 166847
  derived and/or modified sequence opt4 from neuraminidase__InfluenzaA__ABI30535

SEQ ID NO: 167900 - RNA, 1410 nt, Artificial Sequence
  derived and/or modified sequence opt4 from neuraminidase__InfluenzaA__ABI30546
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaaccugcacagcaacgacaccgugcacgacagaacccccuacagaacccugcugaugagcgagcugggcgugcccuuccaccugggcaccaagcaggugugcaucgccuggagcagcagcagcugccacgacggcaaggccuggaugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagaacugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167901 - RNA, 1410 nt, Artificial Sequence; identical to SEQ ID NO: 166847
  derived and/or modified sequence opt4 from neuraminidase__InfluenzaA__ABI30557

SEQ ID NO: 167902 - RNA, 1410 nt, Artificial Sequence; identical to SEQ ID NO: 167234
  derived and/or modified sequence opt4 from neuraminidase__InfluenzaA__ABI30579

SEQ ID NO: 167903 - RNA, 1410 nt, Artificial Sequence
  derived and/or modified sequence opt4 from neuraminidase__InfluenzaA__ABI30590
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagggcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167904 - RNA, 1410 nt, Artificial Sequence; identical to SEQ ID NO: 167327
  derived and/or modified sequence opt4 from neuraminidase__InfluenzaA__ABI30601

SEQ ID NO: 167905 - RNA, 1410 nt, Artificial Sequence
  derived and/or modified sequence opt4 from neuraminidase__InfluenzaA__ABI30612
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucauccacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167906 - RNA, 1410 nt, Artificial Sequence; identical to SEQ ID NO: 167327
  derived and/or modified sequence opt4 from neuraminidase__InfluenzaA__ABI30623

SEQ ID NO: 167907 - RNA, 1410 nt, Artificial Sequence
  derived and/or modified sequence opt4 from neuraminidase__InfluenzaA__ABI30736
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcguggugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167908 - RNA, 1410 nt, Artificial Sequence
  derived and/or modified sequence opt4 from neuraminidase__InfluenzaA__ABI30758
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcuguacgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 167909 - RNA, 1410 nt, Artificial Sequence; identical to SEQ ID NO: 167234
  derived and/or modified sequence opt4 from neuraminidase__InfluenzaA__ABI30769

SEQ ID NO: 167910 - RNA, 1410 nt, Artificial Sequence; identical to SEQ ID NO: 167234
  derived and/or modified sequence opt4 from neuraminidase__InfluenzaA__ABI30780

SEQ ID NO: 167911 - RNA, 1410 nt, Artificial Sequence; identical to SEQ ID NO: 167234
  derived and/or modified sequence opt4 from neuraminidase__InfluenzaA__ABI30791

SEQ ID NO: 167912 - RNA, 1410 nt, Artificial Sequence; identical to SEQ ID NO: 167234
  derived and/or modified sequence opt4 from neuraminidase__InfluenzaA__ABI30802

SEQ ID NO: 167913 - RNA, 1410 nt, Artificial Sequence; identical to SEQ ID NO: 167234
  derived and/or modified sequence opt4 from neuraminidase__InfluenzaA__ABI30813

SEQ ID NO: 167914 - RNA, 1410 nt, Artificial Sequence; identical to SEQ ID NO: 167234
  derived and/or modified sequence opt4 from neuraminidase__InfluenzaA__ABI30824

SEQ ID NO: 167915 - RNA, 1410 nt, Artificial Sequence; identical to SEQ ID NO: 167234
  derived and/or modified sequence opt4 from neuraminidase__InfluenzaA__ABI30835

SEQ ID NO: 167916 - RNA, 1410 nt, Artificial Sequence; identical to SEQ ID NO: 167234
  derived and/or modified sequence opt4 from neuraminidase__InfluenzaA__ABI30846

SEQ ID NO: 167917 - RNA, 1410 nt, Artificial Sequence; identical to SEQ ID NO: 167705
  derived and/or modified sequence opt4 from neuraminidase__InfluenzaA__ABI30857

SEQ ID NO: 167918 - RNA, 1410 nt, Artificial Sequence; identical to SEQ ID NO: 167705
  derived and/or modified sequence opt4 from neuraminidase__InfluenzaA__ABI30868

SEQ ID NO: 167919 - RNA, 1350 nt, Artificial Sequence
  derived and/or modified sequence opt4 from neuraminidase__InfluenzaA__ABI36157
augaaccccaaccagaagaucaucaccaucggcagcaucugcauggccaucggcaccgugagccugaugcugcagaucggcaacaugaucagcaucugggugagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccacagcgagugcagaaccuucuuccugacccagggcgcccugcugaacgacaagcacagcaacgagaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagcagcaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167920 - RNA, 1350 nt, Artificial Sequence; identical to SEQ ID NO: 167919
  derived and/or modified sequence opt4 from neuraminidase__InfluenzaA__ABI36168

SEQ ID NO: 167921 - RNA, 1350 nt, Artificial Sequence; identical to SEQ ID NO: 167919
  derived and/or modified sequence opt4 from neuraminidase__InfluenzaA__ABI36179

SEQ ID NO: 167922 - RNA, 1350 nt, Artificial Sequence; identical to SEQ ID NO: 167919
  derived and/or modified sequence opt4 from neuraminidase__InfluenzaA__ABI36189

SEQ ID NO: 167923 - RNA, 1350 nt, Artificial Sequence
  derived and/or modified sequence opt4 from neuraminidase__InfluenzaA__ABI36278
augaaccccaaccagaagaucaucaccaucggcagcaucugcauggugaucggcaucgugagccugaugcugcagaucggcaacaugaucagcaucugggugagccacagcauccagaagggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167924 - RNA, 1350 nt, Artificial Sequence; identical to SEQ ID NO: 167923
  derived and/or modified sequence opt4 from neuraminidase__InfluenzaA__ABI36287

SEQ ID NO: 167925 - RNA, 1350 nt, Artificial Sequence; identical to SEQ ID NO: 167923
  derived and/or modified sequence opt4 from neuraminidase__InfluenzaA__ABI36298

SEQ ID NO: 167926 - RNA, 1350 nt, Artificial Sequence
  derived and/or modified sequence opt4 from neuraminidase__InfluenzaA__ABI36314
augaaccccaaccagaagaucaucaccaucggcagcaucugcauggugaucggcaucgugagccugaugcugcagaucggcaacaugaucagcaucugggugagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaacagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167927 - RNA, 1350 nt, Artificial Sequence
  derived and/or modified sequence opt4 from neuraminidase__InfluenzaA__ABI36336
augaaccccaaccagaagaucaucaccaucggcagcaucugcauggugaucggcaucgugagccugaugcugcagaucggcaacaugaucagcaucugggugagccacagcgugcagaccggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugcccccugggcgaggcccccagccccuacaacagcagauucgagagcgugagcuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcaucaucagcuucugcggcgugaacagcgacaccgugagcuggagcuggcccgacggcgccgagcugcccuucaccaucgacaaguga

SEQ ID NO: 167928 - RNA, 1350 nt, Artificial Sequence
  derived and/or modified sequence opt4 from neuraminidase__InfluenzaA__ABI36358
augaaccccaaccagaagaucaucaccaucggcagcaucugcauggugaucggcaucgugagccugaugcugcagaucggcaacaugaucagcaucugggugagccacagcgugcagaccggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167929 - RNA, 1350 nt, Artificial Sequence; identical to SEQ ID NO: 167919
  derived and/or modified sequence opt4 from neuraminidase__InfluenzaA__ABI36369

SEQ ID NO: 167930 - RNA, 1350 nt, Artificial Sequence
  derived and/or modified sequence opt4 from neuraminidase__InfluenzaA__ABI36391
augaaccccaaccagaagaucaucaccaucggcagcaucugcauggugaucggcaucgugagccugaugcugcagaucggcaacaugaucagcaucugggugagccacagcacccagaagggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcaucuucggcgacaaccccagacccaacgacggcaccggcagcugcggccccauguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167931 - RNA, 1350 nt, Artificial Sequence; identical to SEQ ID NO: 167930
  derived and/or modified sequence opt4 from neuraminidase__InfluenzaA__ABI36402

SEQ ID NO: 167932 - RNA, 1350 nt, Artificial Sequence; identical to SEQ ID NO: 167919
  derived and/or modified sequence opt4 from neuraminidase__InfluenzaA__ABI36413

SEQ ID NO: 167933 - RNA, 1350 nt, Artificial Sequence
  derived and/or modified sequence opt4 from neuraminidase__InfluenzaA__ABI36446
augaaccccaaccagaagaucaucaccaucggcagcaucugcauggugaucggcaucgugagccugaugcugcagaucggcaacaugaucagcaucugggugagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccuggaucagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167934 - RNA, 1350 nt, Artificial Sequence; identical to SEQ ID NO: 167923
  derived and/or modified sequence opt4 from neuraminidase__InfluenzaA__ABI36457

SEQ ID NO: 167935 - RNA, 1350 nt, Artificial Sequence
  derived and/or modified sequence opt4 from neuraminidase__InfluenzaA__ABI36476
augaaccccaaccagaagaucaucaccaucggcagcaucugcauggugaucggcaucgugagccugaugcugcagaucggcaacaugaucagcaucugggugagccacagcacccagaagggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167936 - RNA, 1350 nt, Artificial Sequence
  derived and/or modified sequence opt4 from neuraminidase__InfluenzaA__ABI49409
augaaccccaacagaaagaucaucaccaucggcagcaucugcauggugaucggcauggugagccugaugcugcagaucggcaacaugaucagcaucugggugagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugguggcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgccagcuggagcuggcccgacggcgccgagcugcccuucaccaucgacaaguga

SEQ ID NO: 167937 - RNA, 1350 nt, Artificial Sequence
  derived and/or modified sequence opt4 from neuraminidase__InfluenzaA__ABI49417
augaaccccaaccagaagaucaucaccaucggcagcaucugcauggugaucggcaucgugagccugaugcugcagaucggcaacaugaucagcaucugggugagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugaccagaggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggccagcccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 167938 - RNA, 1410 nt, Artificial Sequence
  derived and/or modified sequence opt4 from neuraminidase__InfluenzaA__ABI84962
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggacagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 167939 - RNA, 1410 nt, Artificial Sequence
  derived and/or modified sequence opt4 from neuraminidase__InfluenzaA__ABI85003
augaaccccaaccagaagaucaucaccaucggcguggugaacaccacccugagcaccaucgcccugcugaucggcgugggcaaccugguguucaacaccgugauccacgagaagaucggcgaccaccagaucgugacccaccccaccaucaugacccccgaggugcccaacugcagcgacaccaucaucaccuacaacaacaccgugaucaacaacaucaccaccaccaucaucaccgaggccgagagacccuucaagagcccccugccccugugccccuucagaggcuucuuccccuuccacaaggacaacgccaucagacugggcgagaacaaggacgugaucgugaccagagagcccuacgugagcugcgacaacgacaacugcuggagcuucgcccuggcccagggcgcccugcugggcaccaagcacagcaacggcaccaucaaggacagaacccccuacagaagccugaucagauuccccaucggcaccgcccccgugcugggcaacuacaaggagaucugcaucgccuggagcagcagcagcugcuucgacggcaaggaguggaugcacgugugcaugaccggcaacgacaacgacgccagcgcccagaucaucuacggcggcagaaugaccgacagcaucaagagcuggagaaaggacauccugagaacccaggagagcgagugccagugcaucgacggcaccugcgugguggccgugaccgacggccccgccgccaacagcgccgaccacagaguguacuggaucagagagggcagaaucaucaaguacgagaacgugcccaagaccaagauccagcaccuggaggagugcagcugcuacguggacaucgacguguacugcaucugcagagacaacuggaagggcagcaacagacccuggaugagaaucaacaacgagaccauccuggagaccggcuacgugugcagcaaguuccacagcgacacccccagacccgccgaccccagcaucaugagcugcgacagccccagcaacgugaacggcggccccggcgugaagggcuucggcuucaaggccggcaacgacguguggcugggcagaaccgugagcaccagcggcagaagcggcuucgagaucaucaaggugaccgagggcuggaucaacagccccaaccacgugaagagcaucacccagacccuggugagcaacaacgacuggagcggcuacagcggcagcuucaucgugaaggccaaggacugcuuccagcccugcuucuacguggagcugaucagaggcagacccaacaagaacgacgacgugagcuggaccagcaacagcaucgugaccuucugcggccuggacaacgagcccggcagcggcaacuggcccgacggcagcaacaucggcuucaugcccaaguga

SEQ ID NO: 167940 - RNA, 1410 nt, Artificial Sequence; identical to SEQ ID NO: 167610
  derived and/or modified sequence opt4 from neuraminidase__InfluenzaA__ABI92294

SEQ ID NO: 167941 - RNA, 1413 nt, Artificial Sequence
  derived and/or modified sequence opt4 from neuraminidase__InfluenzaA__ABI92305
augaaccccaaccagaagaucaucaccaucggcagcaucugcauggccaucggcaucaucagccugauccugcagaucggcaacaucaucagcaucugggugagccaccugauccagaccggcagccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccgugagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcaucaacggcagcugcuucaccaucaugaccgacggccccagcaacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcggccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 167942 - RNA, 1413 nt, Artificial Sequence
  derived and/or modified sequence opt4 from neuraminidase__InfluenzaA__ABI92316
augaaccccaaccagaagaucaucaccaucggcagcaucagcaucgccaucggcgugaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 167943 - RNA, 1410 nt, Artificial Sequence; identical to SEQ ID NO: 167621
  derived and/or modified sequence opt4 from neuraminidase__InfluenzaA__ABI92327

SEQ ID NO: 167944 - RNA, 1410 nt, Artificial Sequence
  derived and/or modified sequence opt4 from neuraminidase__InfluenzaA__ABI92338
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccgccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugaacaucagcacccugagcggcagcgcccagcacguggaggagugcagcugcuaccccagauaccccggcgugagaugcgugugcagagacaacuggaagggcagcaacagacccaucaucgacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167945 - RNA, 1410 nt, Artificial Sequence
  derived and/or modified sequence opt4 from neuraminidase__InfluenzaA__ABI92349
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccaaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaucggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167946 - RNA, 1410 nt, Artificial Sequence; identical to SEQ ID NO: 166847
  derived and/or modified sequence opt4 from neuraminidase__InfluenzaA__ABI92360

SEQ ID NO: 167947 - RNA, 1410 nt, Artificial Sequence; identical to SEQ ID NO: 166847
  derived and/or modified sequence opt4 from neuraminidase__InfluenzaA__ABI92371

SEQ ID NO: 167948 - RNA, 1413 nt, Artificial Sequence; identical to SEQ ID NO: 166906
  derived and/or modified sequence opt4 from neuraminidase__InfluenzaA__ABI92382

SEQ ID NO: 167949 - RNA, 1410 nt, Artificial Sequence; identical to SEQ ID NO: 167234
  derived and/or modified sequence opt4 from neuraminidase__InfluenzaA__ABI92393

SEQ ID NO: 167950 - RNA, 1410 nt, Artificial Sequence; identical to SEQ ID NO: 166847
  derived and/or modified sequence opt4 from neuraminidase__InfluenzaA__ABI92404

SEQ ID NO: 167951 - RNA, 1410 nt, Artificial Sequence
  derived and/or modified sequence opt4 from neuraminidase__InfluenzaA__ABI92415
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaacuucaugcccaucuga

SEQ ID NO: 167952 - RNA, 1410 nt, Artificial Sequence; identical to SEQ ID NO: 167234
  derived and/or modified sequence opt4 from neuraminidase__InfluenzaA__ABI92426

SEQ ID NO: 167953 - RNA, 1410 nt, Artificial Sequence; identical to SEQ ID NO: 167234
  derived and/or modified sequence opt4 from neuraminidase__InfluenzaA__ABI92437

SEQ ID NO: 167954 - RNA, 1410 nt, Artificial Sequence; identical to SEQ ID NO: 167234
  derived and/or modified sequence opt4 from neuraminidase__InfluenzaA__ABI92448

SEQ ID NO: 167955 - RNA, 1410 nt, Artificial Sequence; identical to SEQ ID NO: 167234
  derived and/or modified sequence opt4 from neuraminidase__InfluenzaA__ABI92459

SEQ ID NO: 167956 - RNA, 1410 nt, Artificial Sequence
  derived and/or modified sequence opt4 from neuraminidase__InfluenzaA__ABI92470
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcgagaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167957 - RNA, 1410 nt, Artificial Sequence; identical to SEQ ID NO: 167250
  derived and/or modified sequence opt4 from neuraminidase__InfluenzaA__ABI92481

SEQ ID NO: 167958 - RNA, 1410 nt, Artificial Sequence; identical to SEQ ID NO: 167250
  derived and/or modified sequence opt4 from neuraminidase__InfluenzaA__ABI92492

SEQ ID NO: 167959 - RNA, 1410 nt, Artificial Sequence
  derived and/or modified sequence opt4 from neuraminidase__InfluenzaA__ABI92503
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggaggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 167960 - RNA, 1410 nt, Artificial Sequence
  derived and/or modified sequence opt4 from neuraminidase__InfluenzaA__ABI92514
augaaccccaaccagaagaucaucaccaucggcagcgugagccugaccaucgccaccaucugcuuccuggugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcgacgacguguggaugggcagaaccaucagcgagaagagcagaagcggcuacgagaccuucaaggugaucgagggcuggagcaagcccaacagcaagcugcagaucaacagacaggugaucguggagagaggcaacaugagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 167961 - RNA, 1410 nt, Artificial Sequence
  derived and/or modified sequence opt4 from neuraminidase__InfluenzaA__ABI92525
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167962 - RNA, 1410 nt, Artificial Sequence
  derived and/or modified sequence opt4 from neuraminidase__InfluenzaA__ABI92536
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaagugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcgccggcagcuggcccgacggcgccgacaucaaccugaugcccaucuga

SEQ ID NO: 167963 - RNA, 1410 nt, Artificial Sequence
  derived and/or modified sequence opt4 from neuraminidase__InfluenzaA__ABI92547
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaugugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcgccggcagcuggcccgacggcgccgacaucaaccugaugcccaucuga

SEQ ID NO: 167964 - RNA, 1410 nt, Artificial Sequence
  derived and/or modified sequence opt4 from neuraminidase__InfluenzaA__ABI92558
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcagaccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167965 - RNA, 1410 nt, Artificial Sequence
  derived and/or modified sequence opt4 from neuraminidase__InfluenzaA__ABI92569
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcaagcugguggacagcaucggcagcuggagcaagaagauccugagaacccaggagagcgagugcgugugcaucaacggcaccugcgccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167966 - RNA, 1410 nt, Artificial Sequence
  derived and/or modified sequence opt4 from neuraminidase__InfluenzaA__ABI92580
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaacaaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagggcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167967 - RNA, 1410 nt, Artificial Sequence
  derived and/or modified sequence opt4 from neuraminidase__InfluenzaA__ABI92591
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugagaaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagccugagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagggcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167968 - RNA, 1410 nt, Artificial Sequence
  derived and/or modified sequence opt4 from neuraminidase__InfluenzaA__ABI92602
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagccugaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcaggugaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167969 - RNA, 1410 nt, Artificial Sequence
  derived and/or modified sequence opt4 from neuraminidase__InfluenzaA__ABI92613
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacaacgagaacgccaccgccagcuucaucuacaacggcaagcugguggacagcaucggcagcuggagcaagaagauccugagaacccaggagagcgagugcgugugcaucaacggcaccugcgccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167970 - RNA, 1410 nt, Artificial Sequence
  derived and/or modified sequence opt4 from neuraminidase__InfluenzaA__ABI92624
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaucagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167971 - RNA, 1410 nt, Artificial Sequence
  derived and/or modified sequence opt4 from neuraminidase__InfluenzaA__ABI92635
augaaccccaaccagaagaucaucaccaucggcagcgugagccugaccaucgccaccaucugcuuccugaugcagaucgccauccuggugaccaccgugacccugcacuucaagcaguacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaaccugaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagaucaucuucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167972 - RNA, 1410 nt, Artificial Sequence; identical to SEQ ID NO: 166665
  derived and/or modified sequence opt4 from neuraminidase__InfluenzaA__ABI92646

SEQ ID NO: 167973 - RNA, 1410 nt, Artificial Sequence; identical to SEQ ID NO: 166665
  derived and/or modified sequence opt4 from neuraminidase__InfluenzaA__ABI92657

SEQ ID NO: 167974 - RNA, 1410 nt, Artificial Sequence
  derived and/or modified sequence opt4 from neuraminidase__InfluenzaA__ABI92668
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcggccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167975 - RNA, 1410 nt, Artificial Sequence; identical to SEQ ID NO: 167111
  derived and/or modified sequence opt4 from neuraminidase__InfluenzaA__ABI92679

SEQ ID NO: 167976 - RNA, 1410 nt, Artificial Sequence; identical to SEQ ID NO: 166665
  derived and/or modified sequence opt4 from neuraminidase__InfluenzaA__ABI92701

SEQ ID NO: 167977 - RNA, 1410 nt, Artificial Sequence
  derived and/or modified sequence opt4 from neuraminidase__InfluenzaA__ABI92712
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggccaugcugugcgagcccaccaccaccgagagaaacaccaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167978 - RNA, 1410 nt, Artificial Sequence
  derived and/or modified sequence opt4 from neuraminidase__InfluenzaA__ABI92723
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167979 - RNA, 1410 nt, Artificial Sequence; identical to SEQ ID NO: 166665
  derived and/or modified sequence opt4 from neuraminidase__InfluenzaA__ABI92734

SEQ ID NO: 167980 - RNA, 1410 nt, Artificial Sequence; identical to SEQ ID NO: 167111
  derived and/or modified sequence opt4 from neuraminidase__InfluenzaA__ABI92745

SEQ ID NO: 167981 - RNA, 1410 nt, Artificial Sequence
  derived and/or modified sequence opt4 from neuraminidase__InfluenzaA__ABI92756
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugauccugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167982 - RNA, 1410 nt, Artificial Sequence
  derived and/or modified sequence opt4 from neuraminidase__InfluenzaA__ABI92767
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggagaagaccgaggugugguggaccagcaacagcaucgugguguucugcggcaccagcggcaccuacggcaccggcagcuggcccgacggcgccgacaucaaccugaugcccaucuga

SEQ ID NO: 167983 - RNA, 1410 nt, Artificial Sequence; identical to SEQ ID NO: 166665
  derived and/or modified sequence opt4 from neuraminidase__InfluenzaA__ABI92778

SEQ ID NO: 167984 - RNA, 1410 nt, Artificial Sequence; identical to SEQ ID NO: 166847
  derived and/or modified sequence opt4 from neuraminidase__InfluenzaA__ABI92789

SEQ ID NO: 167985 - RNA, 1410 nt, Artificial Sequence; identical to SEQ ID NO: 166847
  derived and/or modified sequence opt4 from neuraminidase__InfluenzaA__ABI92800

SEQ ID NO: 167986 - RNA, 1410 nt, Artificial Sequence; identical to SEQ ID NO: 166847
  derived and/or modified sequence opt4 from neuraminidase__InfluenzaA__ABI92811

SEQ ID NO: 167987 - RNA, 1410 nt, Artificial Sequence; identical to SEQ ID NO: 166847
  derived and/or modified sequence opt4 from neuraminidase__InfluenzaA__ABI92822

SEQ ID NO: 167988 - RNA, 1410 nt, Artificial Sequence; identical to SEQ ID NO: 166847
  derived and/or modified sequence opt4 from neuraminidase__InfluenzaA__ABI92844

SEQ ID NO: 167989 - RNA, 1410 nt, Artificial Sequence; identical to SEQ ID NO: 166847
  derived and/or modified sequence opt4 from neuraminidase__InfluenzaA__ABI92855

SEQ ID NO: 167990 - RNA, 1410 nt, Artificial Sequence
  derived and/or modified sequence opt4 from neuraminidase__InfluenzaA__ABI92866
augaaccccaaccagaagaucaucaccaucggcagcgccagccugaccaucgccaccaucugcuuccugauccagaucgccauccuggugaccaccgugacccugcacuucaagcagcacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucagcagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 167991 - RNA, 1410 nt, Artificial Sequence; identical to SEQ ID NO: 166847
  derived and/or modified sequence opt4 from neuraminidase__InfluenzaA__ABI92877

SEQ ID NO: 167992 - RNA, 1410 nt, Artificial Sequence; identical to SEQ ID NO: 166847
  derived and/or modified sequence opt4 from neuraminidase__InfluenzaA__ABI92888

SEQ ID NO: 167993 - RNA, 1410 nt, Artificial Sequence; identical to SEQ ID NO: 166847
  derived and/or modified sequence opt4 from neuraminidase__InfluenzaA__ABI92899

SEQ ID NO: 167994 - RNA, 1410 nt, Artificial Sequence; identical to SEQ ID NO: 166847
  derived and/or modified sequence opt4 from neuraminidase__InfluenzaA__ABI92910

SEQ ID NO: 167995 - RNA, 1410 nt, Artificial Sequence; identical to SEQ ID NO: 166847
  derived and/or modified sequence opt4 from neuraminidase__InfluenzaA__ABI92921

SEQ ID NO: 167996 - RNA, 1410 nt, Artificial Sequence; identical to SEQ ID NO: 166847
  derived and/or modified sequence opt4 from neuraminidase__InfluenzaA__ABI92932

SEQ ID NO: 167997 - RNA, 1410 nt, Artificial Sequence; identical to SEQ ID NO: 167234
  derived and/or modified sequence opt4 from neuraminidase__InfluenzaA__ABI92943

SEQ ID NO: 167998 - RNA, 1410 nt, Artificial Sequence; identical to SEQ ID NO: 167234
  derived and/or modified sequence opt4 from neuraminidase__InfluenzaA__ABI92954

SEQ ID NO: 167999 - RNA, 1410 nt, Artificial Sequence
  derived and/or modified sequence opt4 from neuraminidase__InfluenzaA__ABI92965
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagaagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168000 - RNA, 1410 nt, Artificial Sequence; identical to SEQ ID NO: 167234
  derived and/or modified sequence opt4 from neuraminidase__InfluenzaA__ABI92976

SEQ ID NO: 168001 - RNA, 1410 nt, Artificial Sequence; identical to SEQ ID NO: 167234
  derived and/or modified sequence opt4 from neuraminidase__InfluenzaA__ABI92987

SEQ ID NO: 168002 - RNA, 1410 nt, Artificial Sequence; identical to SEQ ID NO: 167234
  derived and/or modified sequence opt4 from neuraminidase__InfluenzaA__ABI92998

SEQ ID NO: 168003 - RNA, 1410 nt, Artificial Sequence; identical to SEQ ID NO: 167438
  derived and/or modified sequence opt4 from neuraminidase__InfluenzaA__ABI93009

SEQ ID NO: 168004 - RNA, 1410 nt, Artificial Sequence; identical to SEQ ID NO: 167234
  derived and/or modified sequence opt4 from neuraminidase__InfluenzaA__ABI93020

SEQ ID NO: 168005 - RNA, 1413 nt, Artificial Sequence; identical to SEQ ID NO: 167876
  derived and/or modified sequence opt4 from neuraminidase__InfluenzaA__ABI93031

SEQ ID NO: 168006 - RNA, 1410 nt, Artificial Sequence; identical to SEQ ID NO: 167631
  derived and/or modified sequence opt4 from neuraminidase__InfluenzaA__ABI93042

SEQ ID NO: 168007 - RNA, 1410 nt, Artificial Sequence; identical to SEQ ID NO: 166804
  derived and/or modified sequence opt4 from neuraminidase__InfluenzaA__ABI93053

SEQ ID NO: 168008 - RNA, 1410 nt, Artificial Sequence
  derived and/or modified sequence opt4 from neuraminidase__InfluenzaA__ABI93064
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 168009 - RNA, 1410 nt, Artificial Sequence; identical to SEQ ID NO: 167250
  derived and/or modified sequence opt4 from neuraminidase__InfluenzaA__ABI93075

SEQ ID NO: 168010 - RNA, 1410 nt, Artificial Sequence; identical to SEQ ID NO: 167250
  derived and/or modified sequence opt4 from neuraminidase__InfluenzaA__ABI93086

SEQ ID NO: 168011 - RNA, 1410 nt, Artificial Sequence; identical to SEQ ID NO: 167250
  derived and/or modified sequence opt4 from neuraminidase__InfluenzaA__ABI93097

SEQ ID NO: 168012 - RNA, 1410 nt, Artificial Sequence
  derived and/or modified sequence opt4 from neuraminidase__InfluenzaA__ABI93108
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaacgacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168013 - RNA, 1410 nt, Artificial Sequence
  derived and/or modified sequence opt4 from neuraminidase__InfluenzaA__ABI93119
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacaacagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaagcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168014 - RNA, 1416 nt, Artificial Sequence
  derived and/or modified sequence opt4 from neuraminidase__InfluenzaA__ABI94584
augaaccccaaccagaagcuguucgcccugagcggcguggccaucgcccugagcgugcugaaccugcugaucggcaucagcaacgugggccugaacgugagccugcaccugaaggagaagggccccaagcaggaggagaaccugaccugcaccaccaucaaccagaacaacaccaccgugguggagaacaccuacgugaacaacaccaccaucaucaccaagggcaccgaccugaagacccccagcuaccugcugcugaacaagagccugugcaacguggagggcuggguggugaucgccaaggacaacgccgugagauucggcgagagcgagcagaucaucgugaccagagagcccuacgugagcugcgaccccaccggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaugugcgugggcuggagcagcaccaccugccacgacggcaucgccagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggccuacaccaaggugauguacuuccacaagggccugguggugaaggaggaggagcugagaggcagcgccagacacaucgaggagugcagcugcuacggccacaaccagaaggugaccugcgugugcagagacaacuggcagggcgccaacagacccaucaucgagaucgacaugagcacccuggagcacaccagcagauacgugugcaccggcauccugaccgacaccagcagacccggcgacaagagcagcggcgacugcagcaaccccaucaccggcagccccggcgugcccggcgugaagggcuucggcuuccugaacggcgacaacaccuggcugggcagaaccaucagccccagaagcagaagcggcuucgagaugcugaagauccccaacgccggcaccgaccccaacagcagaaucgccgagagacaggagaucguggacaacaacaacuggagcggcuacagcggcagcuucaucgacuacuggaacgacaacagcgagugcuacaaccccugcuucuacguggagcugaucagaggcagacccgaggaggccaaguacguguggugggccagcaacagccugaucgcccugugcggcagccccuuccccgugggcagcggcagcuuccccgacggcgcccagauccaguacuucagcuga

SEQ ID NO: 168015 - RNA, 1413 nt, Artificial Sequence; identical to SEQ ID NO: 167348
  derived and/or modified sequence opt4 from neuraminidase__InfluenzaA__ABI95220

SEQ ID NO: 168016 - RNA, 1410 nt, Artificial Sequence
  derived and/or modified sequence opt4 from neuraminidase__InfluenzaA__ABI95242
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168017 - RNA, 1413 nt, Artificial Sequence
  derived and/or modified sequence opt4 from neuraminidase__InfluenzaA__ABI95253
augaaccccaaccagaagaucaucaccaucggcagcaucagcaucgccaucggcaucaucagcaucaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcgacggcgccgccagcuacaagaucuucaagaucgagaagggcaaggugaccaagagcaucgagcugaacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168018 - RNA, 1413 nt, Artificial Sequence; identical to SEQ ID NO: 167876
  derived and/or modified sequence opt4 from neuraminidase__InfluenzaA__ABI95264

SEQ ID NO: 168019 - RNA, 1413 nt, Artificial Sequence; identical to SEQ ID NO: 167876
  derived and/or modified sequence opt4 from neuraminidase__InfluenzaA__ABI95275

SEQ ID NO: 168020 - RNA, 1413 nt, Artificial Sequence; identical to SEQ ID NO: 167876
  derived and/or modified sequence opt4 from neuraminidase__InfluenzaA__ABI95286

SEQ ID NO: 168021 - RNA, 1413 nt, Artificial Sequence
  derived and/or modified sequence opt4 from neuraminidase__InfluenzaA__ABI95297
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaagaacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 168022 - RNA, 1410 nt, Artificial Sequence; identical to SEQ ID NO: 167250
  derived and/or modified sequence opt4 from neuraminidase__InfluenzaA__ABI95308

SEQ ID NO: 168023 - RNA, 1413 nt, Artificial Sequence; identical to SEQ ID NO: 166906
  derived and/or modified sequence opt4 from neuraminidase__InfluenzaA__ABI96131

SEQ ID NO: 168024 - RNA, 1413 nt, Artificial Sequence; identical to SEQ ID NO: 166906
  derived and/or modified sequence opt4 from neuraminidase__InfluenzaA__ABI96133

SEQ ID NO: 168025 - RNA, 1413 nt, Artificial Sequence; identical to SEQ ID NO: 166906
  derived and/or modified sequence opt4 from neuraminidase__InfluenzaA__ABI96136

SEQ ID NO: 168026 - RNA, 1410 nt, Artificial Sequence
  derived and/or modified sequence opt4 from neuraminidase__InfluenzaA__ABJ09110
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168027 - RNA, 1410 nt, Artificial Sequence; identical to SEQ ID NO: 167621
  derived and/or modified sequence opt4 from neuraminidase__InfluenzaA__ABJ09143

SEQ ID NO: 168028 - RNA, 1413 nt, Artificial Sequence; identical to SEQ ID NO: 167445
  derived and/or modified sequence opt4 from neuraminidase__InfluenzaA__ABJ09154

SEQ ID NO: 168029 - RNA, 1410 nt, Artificial Sequence; identical to SEQ ID NO: 166847
  derived and/or modified sequence opt4 from neuraminidase__InfluenzaA__ABJ09165

SEQ ID NO: 168030 - RNA, 1410 nt, Artificial Sequence; identical to SEQ ID NO: 166847
  derived and/or modified sequence opt4 from neuraminidase__InfluenzaA__ABJ09176

SEQ ID NO: 168031 - RNA, 1410 nt, Artificial Sequence; identical to SEQ ID NO: 167234
  derived and/or modified sequence opt4 from neuraminidase__InfluenzaA__ABJ09198

SEQ ID NO: 168032 - RNA, 1410 nt, Artificial Sequence; identical to SEQ ID NO: 167234
  derived and/or modified sequence opt4 from neuraminidase__InfluenzaA__ABJ09209

SEQ ID NO: 168033 - RNA, 1410 nt, Artificial Sequence
  derived and/or modified sequence opt4 from neuraminidase__InfluenzaA__ABJ09220
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccaaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggcagaggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 168034 - RNA, 1410 nt, Artificial Sequence; identical to SEQ ID NO: 167250
  derived and/or modified sequence opt4 from neuraminidase__InfluenzaA__ABJ09231

SEQ ID NO: 168035 - RNA, 1410 nt, Artificial Sequence; identical to SEQ ID NO: 167250
  derived and/or modified sequence opt4 from neuraminidase__InfluenzaA__ABJ09242

SEQ ID NO: 168036 - RNA, 1410 nt, Artificial Sequence; identical to SEQ ID NO: 166804
  derived and/or modified sequence opt4 from neuraminidase__InfluenzaA__ABJ09253

SEQ ID NO: 168037 - RNA, 1410 nt, Artificial Sequence
  derived and/or modified sequence opt4 from neuraminidase__InfluenzaA__ABJ09264
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguacaugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagcagcggcuacagcggcaucuucagcguggagggcaagagcugcaucaacagaugcuucuacguggagcugaucagaggcagaaagcaggagaccgaggugugguggaccagcaacagcaucguggugcugugcggcaccagcggcaccuacggcaccggcagcuggcccgacggcgccgacaucaaccugaugcccaucuga

SEQ ID NO: 168038 - RNA, 1410 nt, Artificial Sequence
  derived and/or modified sequence opt4 from neuraminidase__InfluenzaA__ABJ09286
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacaagcaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168039 - RNA, 1410 nt, Artificial Sequence; identical to SEQ ID NO: 166804
  derived and/or modified sequence opt4 from neuraminidase__InfluenzaA__ABJ09308

SEQ ID NO: 168040 - RNA, 1410 nt, Artificial Sequence; identical to SEQ ID NO: 168008
  derived and/or modified sequence opt4 from neuraminidase__InfluenzaA__ABJ09319

SEQ ID NO: 168041 - RNA, 1413 nt, Artificial Sequence; identical to SEQ ID NO: 167473
  derived and/or modified sequence opt4 from neuraminidase__InfluenzaA__ABJ09330

SEQ ID NO: 168042 - RNA, 1410 nt, Artificial Sequence
  derived and/or modified sequence opt4 from neuraminidase__InfluenzaA__ABJ09341
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugcugggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168043 - RNA, 1410 nt, Artificial Sequence
  derived and/or modified sequence opt4 from neuraminidase__InfluenzaA__ABJ09352
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168044 - RNA, 1407 nt, Artificial Sequence
  derived and/or modified sequence opt4 from neuraminidase__InfluenzaA__ABJ09374
augauccagagcaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcaagaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168045 - RNA, 1410 nt, Artificial Sequence; identical to SEQ ID NO: 167234
  derived and/or modified sequence opt4 from neuraminidase__InfluenzaA__ABJ09385

SEQ ID NO: 168046 - RNA, 1410 nt, Artificial Sequence; identical to SEQ ID NO: 166773
  derived and/or modified sequence opt4 from neuraminidase__InfluenzaA__ABJ16590

SEQ ID NO: 168047 - RNA, 1410 nt, Artificial Sequence; identical to SEQ ID NO: 168038
  derived and/or modified sequence opt4 from neuraminidase__InfluenzaA__ABJ16601

SEQ ID NO: 168048 - RNA, 1413 nt, Artificial Sequence
  derived and/or modified sequence opt4 from neuraminidase__InfluenzaA__ABJ16612
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccgugggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168049 - RNA, 1410 nt, Artificial Sequence; identical to SEQ ID NO: 168038
  derived and/or modified sequence opt4 from neuraminidase__InfluenzaA__ABJ16623

SEQ ID NO: 168050 - RNA, 1410 nt, Artificial Sequence
  derived and/or modified sequence opt4 from neuraminidase__InfluenzaA__ABJ16634
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaucaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168051 - RNA, 1413 nt, Artificial Sequence; identical to SEQ ID NO: 166906
  derived and/or modified sequence opt4 from neuraminidase__InfluenzaA__ABJ16656

SEQ ID NO: 168052 - RNA, 1413 nt, Artificial Sequence; identical to SEQ ID NO: 166906
  derived and/or modified sequence opt4 from neuraminidase__InfluenzaA__ABJ16667

SEQ ID NO: 168053 - RNA, 1413 nt, Artificial Sequence
  derived and/or modified sequence opt4 from neuraminidase__InfluenzaA__ABJ16678
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuuccuggugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168054 - RNA, 1413 nt, Artificial Sequence; identical to SEQ ID NO: 166906
  derived and/or modified sequence opt4 from neuraminidase__InfluenzaA__ABJ16689

SEQ ID NO: 168055 - RNA, 1410 nt, Artificial Sequence
  derived and/or modified sequence opt4 from neuraminidase__InfluenzaA__ABJ16700
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcaagaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168056 - RNA, 1410 nt, Artificial Sequence
  derived and/or modified sequence opt4 from neuraminidase__InfluenzaA__ABJ16711
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacgccuggaugggcagaaccaucagcgagaagcugagaagcggcuacgagaccuucaaggugaucgagggcuggagcaagagcaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168057 - RNA, 1413 nt, Artificial Sequence
  derived and/or modified sequence opt4 from neuraminidase__InfluenzaA__ABJ16733
augaaccccaaccagaagaucaucaccaucggcagcaucagcguggccaucggcaucaucaaccugauccugcagaucggcaacaucaucagcaucugggccagccacagcauccagaccggcagccagaacuacaccggcaucugcaaccagagaaucaucaccuacgagaacagaaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacaucuucgugaucagagagcccuucaucagcugcagccaccuggagugcagaaccuucuuccugacccagggcgcccugcugaacgacaagcacagcaacggcaccaucaaggacagaagccccuucagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 168058 - RNA, 1410 nt, Artificial Sequence; identical to SEQ ID NO: 167250
  derived and/or modified sequence opt4 from neuraminidase__InfluenzaA__ABJ16744

SEQ ID NO: 168059 - RNA, 1410 nt, Artificial Sequence; identical to SEQ ID NO: 167250
  derived and/or modified sequence opt4 from neuraminidase__InfluenzaA__ABJ16755

SEQ ID NO: 168060 - RNA, 1410 nt, Artificial Sequence; identical to SEQ ID NO: 167250
  derived and/or modified sequence opt4 from neuraminidase__InfluenzaA__ABJ16766

SEQ ID NO: 168061 - RNA, 1410 nt, Artificial Sequence
  derived and/or modified sequence opt4 from neuraminidase__InfluenzaA__ABJ16777
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168062 - RNA, 1410 nt, Artificial Sequence; identical to SEQ ID NO: 167250
  derived and/or modified sequence opt4 from neuraminidase__InfluenzaA__ABJ16788

SEQ ID NO: 168063 - RNA, 1413 nt, Artificial Sequence; identical to SEQ ID NO: 167488
  derived and/or modified sequence opt4 from neuraminidase__InfluenzaA__ABJ53441

SEQ ID NO: 168064 - RNA, 1413 nt, Artificial Sequence
  derived and/or modified sequence opt4 from neuraminidase__InfluenzaA__ABJ53452
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168065 - RNA, 1410 nt, Artificial Sequence; identical to SEQ ID NO: 167232
  derived and/or modified sequence opt4 from neuraminidase__InfluenzaA__ABJ53463

SEQ ID NO: 168066 - RNA, 1410 nt, Artificial Sequence; identical to SEQ ID NO: 167232
  derived and/or modified sequence opt4 from neuraminidase__InfluenzaA__ABJ53474

SEQ ID NO: 168067 - RNA, 1410 nt, Artificial Sequence
  derived and/or modified sequence opt4 from neuraminidase__InfluenzaA__ABJ53485
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaacagcaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168068 - RNA, 1413 nt, Artificial Sequence; identical to SEQ ID NO: 167876
  derived and/or modified sequence opt4 from neuraminidase__InfluenzaA__ABJ53496

SEQ ID NO: 168069 - RNA, 1413 nt, Artificial Sequence; identical to SEQ ID NO: 167876
  derived and/or modified sequence opt4 from neuraminidase__InfluenzaA__ABJ53507

SEQ ID NO: 168070 - RNA, 1413 nt, Artificial Sequence
  derived and/or modified sequence opt4 from neuraminidase__InfluenzaA__ABJ53518
augaaccccaaccagaagaucaucaccaucggcagcaucagcguggccaucggcaucaucaaccugauccugcagaucggcaacaucaucagcaucugggccagccacagcauccagaccggcagccagaacuacaccggcaucugcaaccagagaaucaucaccuacgagaacagaaccugggugaaccagaccuacgugaacaucaacaacaccaacgugguggccggcaaggacaagaccagcaugacccuggccggcaaccugagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuucagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 168071 - RNA, 1410 nt, Artificial Sequence; identical to SEQ ID NO: 166674
  derived and/or modified sequence opt4 from neuraminidase__InfluenzaA__ABK39965

SEQ ID NO: 168072 - RNA, 1410 nt, Artificial Sequence
  derived and/or modified sequence opt4 from neuraminidase__InfluenzaA__ABK39976
augaaccccaaccagaagaucaucaccaucggcagcgugagccugaccaucagcaccaccugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168073 - RNA, 1410 nt, Artificial Sequence; identical to SEQ ID NO: 167232
  derived and/or modified sequence opt4 from neuraminidase__InfluenzaA__ABK39987

SEQ ID NO: 168074 - RNA, 1410 nt, Artificial Sequence; identical to SEQ ID NO: 166902
  derived and/or modified sequence opt4 from neuraminidase__InfluenzaA__ABK39998

SEQ ID NO: 168075 - RNA, 1410 nt, Artificial Sequence; identical to SEQ ID NO: 166847
  derived and/or modified sequence opt4 from neuraminidase__InfluenzaA__ABK40020

SEQ ID NO: 168076 - RNA, 1413 nt, Artificial Sequence
  derived and/or modified sequence opt4 from neuraminidase__InfluenzaA__ABK40031
augaaccccaaccagaagaucaucaccaucggcagcaucagcguggccaucggcaucaucaaccugauccugcagaucggcaacaucaucagcaucugggccagccacagcauccagaccggcagccagaacuacaccggcaucugcaaccagagaaucaucaccuacgagaacagaaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuucagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 168077 - RNA, 1413 nt, Artificial Sequence; identical to SEQ ID NO: 168076
  derived and/or modified sequence opt4 from neuraminidase__InfluenzaA__ABK40042

SEQ ID NO: 168078 - RNA, 1413 nt, Artificial Sequence; identical to SEQ ID NO: 168076
  derived and/or modified sequence opt4 from neuraminidase__InfluenzaA__ABK40053

SEQ ID NO: 168079 - RNA, 1410 nt, Artificial Sequence; identical to SEQ ID NO: 167250
  derived and/or modified sequence opt4 from neuraminidase__InfluenzaA__ABK40064

SEQ ID NO: 168080 - RNA, 1410 nt, Artificial Sequence; identical to SEQ ID NO: 167250
  derived and/or modified sequence opt4 from neuraminidase__InfluenzaA__ABK40078

SEQ ID NO: 168081 - RNA, 1413 nt, Artificial Sequence; identical to SEQ ID NO: 167579
  derived and/or modified sequence opt4 from neuraminidase__InfluenzaA__ABK40513

SEQ ID NO: 168082 - RNA, 1413 nt, Artificial Sequence; identical to SEQ ID NO: 167579
  derived and/or modified sequence opt4 from neuraminidase__InfluenzaA__ABK40538

SEQ ID NO: 168083 - RNA, 1413 nt, Artificial Sequence
  derived and/or modified sequence opt4 from neuraminidase__InfluenzaA__ABK40549
augaaccccaaccagaagaucaucaccaucggcagcaucugcaugaccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcaacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuacaagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgccaacuggagcuggcccgacggcgccgagcugcccuucaccaucgacaaguga

SEQ ID NO: 168084 - RNA, 1413 nt, Artificial Sequence; identical to SEQ ID NO: 167579
  derived and/or modified sequence opt4 from neuraminidase__InfluenzaA__ABK40560

SEQ ID NO: 168085 - RNA, 1413 nt, Artificial Sequence; identical to SEQ ID NO: 167579
  derived and/or modified sequence opt4 from neuraminidase__InfluenzaA__ABK40571

SEQ ID NO: 168086 - RNA, 1413 nt, Artificial Sequence; identical to SEQ ID NO: 167579
  derived and/or modified sequence opt4 from neuraminidase__InfluenzaA__ABK40582

SEQ ID NO: 168087 - RNA, 1413 nt, Artificial Sequence
  derived and/or modified sequence opt4 from neuraminidase__InfluenzaA__ABK40593
augaaccccaaccagaagaucaucaccaucggcagcaucugcaugaccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcaacggccccgccagccacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuacaagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgccaacuggagcuggcccgacggcgccgagcugcccuucaccaucgacaaguga

SEQ ID NO: 168088 - RNA, 1413 nt, Artificial Sequence; identical to SEQ ID NO: 167579
  derived and/or modified sequence opt4 from neuraminidase__InfluenzaA__ABK40604

SEQ ID NO: 168089 - RNA, 1410 nt, Artificial Sequence; identical to SEQ ID NO: 167250
  derived and/or modified sequence opt4 from neuraminidase__InfluenzaA__ABK40615

SEQ ID NO: 168090 - RNA, 1410 nt, Artificial Sequence; identical to SEQ ID NO: 166581
  derived and/or modified sequence opt4 from neuraminidase__InfluenzaA__ABK40626

SEQ ID NO: 168091 - RNA, 1410 nt, Artificial Sequence
  derived and/or modified sequence opt4 from neuraminidase__InfluenzaA__ABK40648
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcauccccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgacagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagagcagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 168092 - RNA, 1410 nt, Artificial Sequence; identical to SEQ ID NO: 167633
  derived and/or modified sequence opt4 from neuraminidase__InfluenzaA__ABK40659

SEQ ID NO: 168093 - RNA, 1410 nt, Artificial Sequence; identical to SEQ ID NO: 167621
  derived and/or modified sequence opt4 from neuraminidase__InfluenzaA__ABK40681

SEQ ID NO: 168094 - RNA, 1413 nt, Artificial Sequence
  derived and/or modified sequence opt4 from neuraminidase__InfluenzaA__ABK40692
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcugggagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcguggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168095 - RNA, 1410 nt, Artificial Sequence; identical to SEQ ID NO: 167250
  derived and/or modified sequence opt4 from neuraminidase__InfluenzaA__ABK40703

SEQ ID NO: 168096 - RNA, 1410 nt, Artificial Sequence; identical to SEQ ID NO: 167250
  derived and/or modified sequence opt4 from neuraminidase__InfluenzaA__ABK40714

SEQ ID NO: 168097 - RNA, 1410 nt, Artificial Sequence; identical to SEQ ID NO: 167250
  derived and/or modified sequence opt4 from neuraminidase__InfluenzaA__ABK40725

SEQ ID NO: 168098 - RNA, 1410 nt, Artificial Sequence; identical to SEQ ID NO: 167250
  derived and/or modified sequence opt4 from neuraminidase__InfluenzaA__ABK40736

SEQ ID NO: 168099 - RNA, 1410 nt, Artificial Sequence; identical to SEQ ID NO: 167965
  derived and/or modified sequence opt4 from neuraminidase__InfluenzaA__ABK40747

SEQ ID NO: 168100 - RNA, 1413 nt, Artificial Sequence; identical to SEQ ID NO: 167471
  derived and/or modified sequence opt4 from neuraminidase__InfluenzaA__ABK79951

SEQ ID NO: 168101 - RNA, 1413 nt, Artificial Sequence; identical to SEQ ID NO: 168076
  derived and/or modified sequence opt4 from neuraminidase__InfluenzaA__ABK79973

SEQ ID NO: 168102 - RNA, 1410 nt, Artificial Sequence; identical to SEQ ID NO: 167250
  derived and/or modified sequence opt4 from neuraminidase__InfluenzaA__ABK79984

SEQ ID NO: 168103 - RNA, 1410 nt, Artificial Sequence; identical to SEQ ID NO: 167250
  derived and/or modified sequence opt4 from neuraminidase__InfluenzaA__ABK79995

SEQ ID NO: 168104 - RNA, 1413 nt, Artificial Sequence; identical to SEQ ID NO: 167579
  derived and/or modified sequence opt4 from neuraminidase__InfluenzaA__ABK80028

SEQ ID NO: 168105 - RNA, 1413 nt, Artificial Sequence; identical to SEQ ID NO: 167579
  derived and/or modified sequence opt4 from neuraminidase__InfluenzaA__ABK80039

SEQ ID NO: 168106 - RNA, 1413 nt, Artificial Sequence; identical to SEQ ID NO: 167579
  derived and/or modified sequence opt4 from neuraminidase__InfluenzaA__ABK80050

SEQ ID NO: 168107 - RNA, 1410 nt, Artificial Sequence
  derived and/or modified sequence opt4 from neuraminidase__InfluenzaA__ABK80061
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168108 - RNA, 1410 nt, Artificial Sequence; identical to SEQ ID NO: 166581
  derived and/or modified sequence opt4 from neuraminidase__InfluenzaA__ABK80072

SEQ ID NO: 168109 - RNA, 1410 nt, Artificial Sequence
  derived and/or modified sequence opt4 from neuraminidase__InfluenzaA__ABK80083
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168110 - RNA, 1410 nt, Artificial Sequence
  derived and/or modified sequence opt4 from neuraminidase__InfluenzaA__ABK80094
augaaccccaaccagaagaucaucaccaucggcagcgugagccugaucaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168111 - RNA, 1410 nt, Artificial Sequence; identical to SEQ ID NO: 167250
  derived and/or modified sequence opt4 from neuraminidase__InfluenzaA__ABK80105

SEQ ID NO: 168112 - RNA, 1410 nt, Artificial Sequence
  derived and/or modified sequence opt4 from neuraminidase__InfluenzaA__ABK80138
augaaccccaaccagaagaucaucaccaucggcagcgugagccugaccaucgccaccaucugcuuccugaugcagaccgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168113 - RNA, 1410 nt, Artificial Sequence
  derived and/or modified sequence opt4 from neuraminidase__InfluenzaA__ABK80149
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggccaugcuguacgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168114 - RNA, 1410 nt, Artificial Sequence; identical to SEQ ID NO: 168113
  derived and/or modified sequence opt4 from neuraminidase__InfluenzaA__ABK80160

SEQ ID NO: 168115 - RNA, 1410 nt, Artificial Sequence
  derived and/or modified sequence opt4 from neuraminidase__InfluenzaA__ABK80171
augaaccccaaccagaagaucaucaccaucggcagcgugagccugaccaucgccaccaucugcuuccugaugcagaucgccauccuggugaccaccgugacccugcacuucaagcaguacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucuucagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168116 - RNA, 1410 nt, Artificial Sequence
  derived and/or modified sequence opt4 from neuraminidase__InfluenzaA__ABK80182
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcaagcugguggacagcaucggcagcuggagcaagaagauccugagaacccaggagagcgagugcgugugcaucaacggcaccugcgccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168117 - RNA, 1410 nt, Artificial Sequence
  derived and/or modified sequence opt4 from neuraminidase__InfluenzaA__ABK80193
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucggcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168118 - RNA, 1410 nt, Artificial Sequence
  derived and/or modified sequence opt4 from neuraminidase__InfluenzaA__ABK80204
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcaagcugguggacagcaucggcagcuggagcaagaagauccugagaacccaggagagcgagugcgugugcaucaacggcaccugcgccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacgccuggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168119 - RNA, 1410 nt, Artificial Sequence; identical to SEQ ID NO: 167111
  derived and/or modified sequence opt4 from neuraminidase__InfluenzaA__ABK80215

SEQ ID NO: 168120 - RNA, 1410 nt, Artificial Sequence; identical to SEQ ID NO: 167111
  derived and/or modified sequence opt4 from neuraminidase__InfluenzaA__ABK80226

SEQ ID NO: 168121 - RNA, 1410 nt, Artificial Sequence
  derived and/or modified sequence opt4 from neuraminidase__InfluenzaA__ABK80237
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaccgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168122 - RNA, 1410 nt, Artificial Sequence
  derived and/or modified sequence opt4 from neuraminidase__InfluenzaA__ABK80259
augaaccccaaccagaagaucaucaccaucggcagcgccagccugaccaucgccaccaucugcuuccugauccagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucagcagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168123 - RNA, 1410 nt, Artificial Sequence; identical to SEQ ID NO: 166847
  derived and/or modified sequence opt4 from neuraminidase__InfluenzaA__ABK80270

SEQ ID NO: 168124 - RNA, 1410 nt, Artificial Sequence; identical to SEQ ID NO: 167234
  derived and/or modified sequence opt4 from neuraminidase__InfluenzaA__ABK80281

SEQ ID NO: 168125 - RNA, 1410 nt, Artificial Sequence
  derived and/or modified sequence opt4 from neuraminidase__InfluenzaA__ABK80292
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucauccacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaagcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168126 - RNA, 1410 nt, Artificial Sequence
  derived and/or modified sequence opt4 from neuraminidase__InfluenzaA__ABK80303
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcuguacgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcaacgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168127 - RNA, 1410 nt, Artificial Sequence
  derived and/or modified sequence opt4 from neuraminidase__InfluenzaA__ABK80314
augaaccccaaccagaagaucaucaccaucggcagcgugagccugaccaucgccaccaucugcuuccugaugcagaucgccauccuggugaccaccgugacccugcacuucaagcaguacgagugcgacagcccccccaacaaccaggugaugcuguacgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168128 - RNA, 1350 nt, Artificial Sequence
  derived and/or modified sequence opt4 from neuraminidase__InfluenzaA__ABL07021
augaaccccaaccagaagaucaucaccaucggcagcaucugcauggugaucggcaucgugagccugaugcugcagaucggcaacaugaucagcaucugggugagccacagcauccagaagggcaaccagcaccaggccgagagcaucagcaacaccaacccccugaccgagaaggccguggccagcaucacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagaugaagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 168129 - RNA, 1350 nt, Artificial Sequence
  derived and/or modified sequence opt4 from neuraminidase__InfluenzaA__ABL07032
augaaccccaaccagaagaucaucaccaucggcagcaucugcauggugaucggcaucgugagccugaugcugcagaucggcaacauggugagcaccugggugagccacagcauccagaccggcaaccaguaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 168130 - RNA, 1350 nt, Artificial Sequence
  derived and/or modified sequence opt4 from neuraminidase__InfluenzaA__ABL31746
augaaccccaaccagaagaucaucaccaucggcagcaucugcauggugaucggcaucgugagccugaugcugcagaucggcaacaugaucagcaucugggugagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaacagcuggcugaccaucggcaucagcggccccgacaacgaggccguggccgugcugaaguacaacggcaucaucaccgacaccaucaagagcuggagaaagaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 168131 - RNA, 1350 nt, Artificial Sequence
  derived and/or modified sequence opt4 from neuraminidase__InfluenzaA__ABL31757
augaaccccaaccagaagaucaucaccaucggcagcaucugcauggugaucggcaucgugagccugaugcugcagaucggcaacaugaucagcaucugggugagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 168132 - RNA, 1350 nt, Artificial Sequence; identical to SEQ ID NO: 168131
  derived and/or modified sequence opt4 from neuraminidase__InfluenzaA__ABL31768

SEQ ID NO: 168133 - RNA, 1410 nt, Artificial Sequence; identical to SEQ ID NO: 167111
  derived and/or modified sequence opt4 from neuraminidase__InfluenzaA__ABL67168

SEQ ID NO: 168134 - RNA, 1410 nt, Artificial Sequence; identical to SEQ ID NO: 167250
  derived and/or modified sequence opt4 from neuraminidase__InfluenzaA__ABL67179

SEQ ID NO: 168135 - RNA, 1413 nt, Artificial Sequence; identical to SEQ ID NO: 168076
  derived and/or modified sequence opt4 from neuraminidase__InfluenzaA__ABL67190

SEQ ID NO: 168136 - RNA, 1410 nt, Artificial Sequence
  derived and/or modified sequence opt4 from neuraminidase__InfluenzaA__ABL67201
augaaccccaaccagaagaucaucaccaucagcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168137 - RNA, 1413 nt, Artificial Sequence; identical to SEQ ID NO: 168076
  derived and/or modified sequence opt4 from neuraminidase__InfluenzaA__ABL67212

SEQ ID NO: 168138 - RNA, 1413 nt, Artificial Sequence; identical to SEQ ID NO: 167579
  derived and/or modified sequence opt4 from neuraminidase__InfluenzaA__ABL67256

SEQ ID NO: 168139 - RNA, 1413 nt, Artificial Sequence; identical to SEQ ID NO: 167579
  derived and/or modified sequence opt4 from neuraminidase__InfluenzaA__ABL67267

SEQ ID NO: 168140 - RNA, 1410 nt, Artificial Sequence; identical to SEQ ID NO: 166581
  derived and/or modified sequence opt4 from neuraminidase__InfluenzaA__ABL67278

SEQ ID NO: 168141 - RNA, 1410 nt, Artificial Sequence
  derived and/or modified sequence opt4 from neuraminidase__InfluenzaA__ABL67289
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcuguacgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168142 - RNA, 1410 nt, Artificial Sequence
  derived and/or modified sequence opt4 from neuraminidase__InfluenzaA__ABL67300
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggaccacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168143 - RNA, 1410 nt, Artificial Sequence; identical to SEQ ID NO: 166700
  derived and/or modified sequence opt4 from neuraminidase__InfluenzaA__ABL67311

SEQ ID NO: 168144 - RNA, 1410 nt, Artificial Sequence
  derived and/or modified sequence opt4 from neuraminidase__InfluenzaA__ABL67322
augaaccccaaccagaagaucaucaccaucggcagcgugagccugaccaucgccaccaucugcuuccugaugcagaucgccauccuggugaccaccgugacccugcacuucaagcaguacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168145 - RNA, 1410 nt, Artificial Sequence
  derived and/or modified sequence opt4 from neuraminidase__InfluenzaA__ABL67333
augaaccccaaccagaagaucaucaccaucggcagcgugagccugaccaucgccaccaucugcuuccugaugcagaucgccauccuggugaucaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcaagcugguggacagcaucggcagcuggagcaagaagauccugagaacccaggagagcgagugcgugugcaucaacggcaccugcgccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168146 - RNA, 1410 nt, Artificial Sequence; identical to SEQ ID NO: 167111
  derived and/or modified sequence opt4 from neuraminidase__InfluenzaA__ABL67344

SEQ ID NO: 168147 - RNA, 1410 nt, Artificial Sequence
  derived and/or modified sequence opt4 from neuraminidase__InfluenzaA__ABL67355
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgagaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168148 - RNA, 1410 nt, Artificial Sequence
  derived and/or modified sequence opt4 from neuraminidase__InfluenzaA__ABL67366
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccagaauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168149 - RNA, 1410 nt, Artificial Sequence
  derived and/or modified sequence opt4 from neuraminidase__InfluenzaA__ABL67377
augaaccccaaccagaagaucaucaccaucggcagcgccagccugaccaucgccaucaucugcuuccugauccagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucagcagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgaccugaaccugaugcccaucuga

SEQ ID NO: 168150 - RNA, 1410 nt, Artificial Sequence; identical to SEQ ID NO: 166847
  derived and/or modified sequence opt4 from neuraminidase__InfluenzaA__ABL67388

SEQ ID NO: 168151 - RNA, 1410 nt, Artificial Sequence; identical to SEQ ID NO: 166847
  derived and/or modified sequence opt4 from neuraminidase__InfluenzaA__ABL67399

SEQ ID NO: 168152 - RNA, 1410 nt, Artificial Sequence; identical to SEQ ID NO: 167232
  derived and/or modified sequence opt4 from neuraminidase__InfluenzaA__ABL67410

SEQ ID NO: 168153 - RNA, 1410 nt, Artificial Sequence
  derived and/or modified sequence opt4 from neuraminidase__InfluenzaA__ABL67421
augaaccccaaccagaagaucaucaccaucggcagcaucagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168154 - RNA, 1350 nt, Artificial Sequence
  derived and/or modified sequence opt4 from neuraminidase__InfluenzaA__ABL67772
augaaccccaacaagaagaucaucaccaucggcagcaucugcauggugaccggcauggugagccugaugcugcagaucggcaaccugaucagcaucugggugagccacagcauccacaccggcaaccagcacaaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccugaaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 168155 - RNA, 1350 nt, Artificial Sequence
  derived and/or modified sequence opt4 from neuraminidase__InfluenzaA__ABL67783
augaaccccaacaagaagaucaucaccaucggcagcaucugcauggugaccggcauggugagccugaugcugcagaucggcaaccugaucagcaucugggugagccacagcauccacaccggcaaccagcacaaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 168156 - RNA, 1350 nt, Artificial Sequence
  derived and/or modified sequence opt4 from neuraminidase__InfluenzaA__ABL67796
augaaccccaacaagaagaucaucaccaucggcagcaucugcauggugaccggcauggugagccugaugcugcagaucggcaaccugaucagcaucugggugagccacagcauccacaccggcaaccagcacaaggccgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcuacaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 168157 - RNA, 1350 nt, Artificial Sequence
  derived and/or modified sequence opt4 from neuraminidase__InfluenzaA__ABL67807
augaaccccaacaagaagaucaucaccaucggcagcaucugcauggugaccggcauggugagccugaugcugcagaucggcaaccugaucagcaucugggugagccacagcauccacaccggcaaccagcacaaggccgagcccaucagcaacaccaaccugcugaccgagaaggccguggccagcgugaagcuggccggcaacagcagccugugccccaucgacggcugggccguguacagcaaggacaacagcaucagaaucggcagcaagggcgacguguucguggugagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcgccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 168158 - RNA, 1350 nt, Artificial Sequence
  derived and/or modified sequence opt4 from neuraminidase__InfluenzaA__ABL67818
augaaccccaacaagaagaucaucaccaucggcagcaucugcauggugaccggcauggugagccugaugcugcagaucggcaaccugaucagcaucugggugagccacagcauccacaccggcaaccagcacaaggccgagcccaucagcaacaccaaccugcugaccgagaaggccguggccagcgugaagcuggccggcaacagcagccugugccccaucgacggcugggccguguacagcaaggacaacagcaucagaaucggcagcaagggcgacguguucguggugagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcuacugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcgccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 168159 - RNA, 1350 nt, Artificial Sequence
  derived and/or modified sequence opt4 from neuraminidase__InfluenzaA__ABL67829
augaaccccaacaagaagaucaucaccaucggcagcaucugcauggugaccggcauggugagccugaugcugcagaucggcaaccugaucagcaucugggugagccacagcauccacaccggcaaccagcacaaggccgagcccaucagcaacaccaaccugcugaccgagaaggccguggccagcgugaagcuggccggcaacagcagccugugccccaucaacggcugggccguguacagcaaggacaacagcaucagaaucggcagcaagggcgacguguucguggugagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcuucugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcgccggcagcugcggccccguggccagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 168160 - RNA, 1410 nt, Artificial Sequence; identical to SEQ ID NO: 167232
  derived and/or modified sequence opt4 from neuraminidase__InfluenzaA__ABM22018

SEQ ID NO: 168161 - RNA, 1413 nt, Artificial Sequence; identical to SEQ ID NO: 168076
  derived and/or modified sequence opt4 from neuraminidase__InfluenzaA__ABM22029

SEQ ID NO: 168162 - RNA, 1410 nt, Artificial Sequence; identical to SEQ ID NO: 167234
  derived and/or modified sequence opt4 from neuraminidase__InfluenzaA__ABM22040

SEQ ID NO: 168163 - RNA, 1410 nt, Artificial Sequence; identical to SEQ ID NO: 168141
  derived and/or modified sequence opt4 from neuraminidase__InfluenzaA__ABM22062

SEQ ID NO: 168164 - RNA, 1410 nt, Artificial Sequence
  derived and/or modified sequence opt4 from neuraminidase__InfluenzaA__ABM22073
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuucaaccugggcaccagacaggugugcaucgccuggagcagcagcagcugccacgacggcaaggccuggcugcacgugugcgugaccggcgacgacgagaacgccaccgccagcuucaucuacaacggcaagcugguggacagcaucggcagcuggagcaagaagauccugagaacccaggagagcgagugcgugugcaucaacggcaccugcgccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168165 - RNA, 1410 nt, Artificial Sequence; identical to SEQ ID NO: 167111
  derived and/or modified sequence opt4 from neuraminidase__InfluenzaA__ABM22084

SEQ ID NO: 168166 - RNA, 1410 nt, Artificial Sequence
  derived and/or modified sequence opt4 from neuraminidase__InfluenzaA__ABM22095
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggccaugcugugcgagcccaccaucaucgagagaaacaucaccgagaucgugcaccugaccaacaccaccaucgagaaggagaucugccccaagcugguggaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168167 - RNA, 1410 nt, Artificial Sequence; identical to SEQ ID NO: 167111
  derived and/or modified sequence opt4 from neuraminidase__InfluenzaA__ABM22106

SEQ ID NO: 168168 - RNA, 1410 nt, Artificial Sequence; identical to SEQ ID NO: 167111
  derived and/or modified sequence opt4 from neuraminidase__InfluenzaA__ABM22117

SEQ ID NO: 168169 - RNA, 1410 nt, Artificial Sequence; identical to SEQ ID NO: 168122
  derived and/or modified sequence opt4 from neuraminidase__InfluenzaA__ABM22128

SEQ ID NO: 168170 - RNA, 1410 nt, Artificial Sequence
  derived and/or modified sequence opt4 from neuraminidase__InfluenzaA__ABM22139
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcgagaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168171 - RNA, 1410 nt, Artificial Sequence
  derived and/or modified sequence opt4 from neuraminidase__InfluenzaA__ABM22150
augaaccccaaccagaagaucaucaccaucggcagcgugagccugaccaucagcaccaucugcuucuucaugcagaucgccauccugaucaccaccgugacccugcacuucaagcaguacgaguucaacagccugcccaacaaccaggugaugcugugcgagcccaccaucaucgagagaaacaucaccgagaucguguaccugaccaacaccaccaucgagaaggagaucugccccgagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168172 - RNA, 1413 nt, Artificial Sequence; identical to SEQ ID NO: 167579
  derived and/or modified sequence opt4 from neuraminidase__InfluenzaA__ABM22161

SEQ ID NO: 168173 - RNA, 1413 nt, Artificial Sequence; identical to SEQ ID NO: 167579
  derived and/or modified sequence opt4 from neuraminidase__InfluenzaA__ABM22172

SEQ ID NO: 168174 - RNA, 1413 nt, Artificial Sequence; identical to SEQ ID NO: 167579
  derived and/or modified sequence opt4 from neuraminidase__InfluenzaA__ABM22183

SEQ ID NO: 168175 - RNA, 1413 nt, Artificial Sequence; identical to SEQ ID NO: 167579
  derived and/or modified sequence opt4 from neuraminidase__InfluenzaA__ABM22194

SEQ ID NO: 168176 - RNA, 1413 nt, Artificial Sequence; identical to SEQ ID NO: 167579
  derived and/or modified sequence opt4 from neuraminidase__InfluenzaA__ABM22205

SEQ ID NO: 168177 - RNA, 1413 nt, Artificial Sequence; identical to SEQ ID NO: 167579
  derived and/or modified sequence opt4 from neuraminidase__InfluenzaA__ABM22216

SEQ ID NO: 168178 - RNA, 1413 nt, Artificial Sequence; identical to SEQ ID NO: 167579
  derived and/or modified sequence opt4 from neuraminidase__InfluenzaA__ABM22227

SEQ ID NO: 168179 - RNA, 1413 nt, Artificial Sequence; identical to SEQ ID NO: 167579
  derived and/or modified sequence opt4 from neuraminidase__InfluenzaA__ABM22238

SEQ ID NO: 168180 - RNA, 1413 nt, Artificial Sequence
  derived and/or modified sequence opt4 from neuraminidase__InfluenzaA__ABM22271
augaaccccaaccagaagaucaucaccaucggcagcaucagcaucgugaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcagagugaccaagagcaucgagcugggcgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168181 - RNA, 1413 nt, Artificial Sequence; identical to SEQ ID NO: 167488
  derived and/or modified sequence opt4 from neuraminidase__InfluenzaA__ABM22282

SEQ ID NO: 168182 - RNA, 1410 nt, Artificial Sequence; identical to SEQ ID NO: 166863
  derived and/or modified sequence opt4 from neuraminidase__InfluenzaA__ABM22304

SEQ ID NO: 168183 - RNA, 1410 nt, Artificial Sequence; identical to SEQ ID NO: 166863
  derived and/or modified sequence opt4 from neuraminidase__InfluenzaA__ABM22315

SEQ ID NO: 168184 - RNA, 1410 nt, Artificial Sequence; identical to SEQ ID NO: 166863
  derived and/or modified sequence opt4 from neuraminidase__InfluenzaA__ABM22326

SEQ ID NO: 168185 - RNA, 1410 nt, Artificial Sequence; identical to SEQ ID NO: 166863
  derived and/or modified sequence opt4 from neuraminidase__InfluenzaA__ABM22337

SEQ ID NO: 168186 - RNA, 1410 nt, Artificial Sequence; identical to SEQ ID NO: 166866
  derived and/or modified sequence opt4 from neuraminidase__InfluenzaA__ABM22348

SEQ ID NO: 168187 - RNA, 1410 nt, Artificial Sequence; identical to SEQ ID NO: 166866
  derived and/or modified sequence opt4 from neuraminidase__InfluenzaA__ABM22359

SEQ ID NO: 168188 - RNA, 1410 nt, Artificial Sequence; identical to SEQ ID NO: 166866
  derived and/or modified sequence opt4 from neuraminidase__InfluenzaA__ABM22370

SEQ ID NO: 168189 - RNA, 1413 nt, Artificial Sequence; identical to SEQ ID NO: 167445
  derived and/or modified sequence opt4 from neuraminidase__InfluenzaA__ABM66867

SEQ ID NO: 168190 - RNA, 1413 nt, Artificial Sequence; identical to SEQ ID NO: 167579
  derived and/or modified sequence opt4 from neuraminidase__InfluenzaA__ABM66900

SEQ ID NO: 168191 - RNA, 1413 nt, Artificial Sequence; identical to SEQ ID NO: 167579
  derived and/or modified sequence opt4 from neuraminidase__InfluenzaA__ABM66911

SEQ ID NO: 168192 - RNA, 1410 nt, Artificial Sequence; identical to SEQ ID NO: 166866
  derived and/or modified sequence opt4 from neuraminidase__InfluenzaA__ABM66922

SEQ ID NO: 168193 - RNA, 1410 nt, Artificial Sequence; identical to SEQ ID NO: 166866
  derived and/or modified sequence opt4 from neuraminidase__InfluenzaA__ABM66933

SEQ ID NO: 168194 - RNA, 1410 nt, Artificial Sequence; identical to SEQ ID NO: 166866
  derived and/or modified sequence opt4 from neuraminidase__InfluenzaA__ABM66944

SEQ ID NO: 168195 - RNA, 1410 nt, Artificial Sequence; identical to SEQ ID NO: 166866
  derived and/or modified sequence opt4 from neuraminidase__InfluenzaA__ABM66955

SEQ ID NO: 168196 - RNA, 1410 nt, Artificial Sequence; identical to SEQ ID NO: 166866
  derived and/or modified sequence opt4 from neuraminidase__InfluenzaA__ABM66966

SEQ ID NO: 168197 - RNA, 1410 nt, Artificial Sequence; identical to SEQ ID NO: 166866
  derived and/or modified sequence opt4 from neuraminidase__InfluenzaA__ABM66977

SEQ ID NO: 168198 - RNA, 1410 nt, Artificial Sequence; identical to SEQ ID NO: 166866
  derived and/or modified sequence opt4 from neuraminidase__InfluenzaA__ABM66988

SEQ ID NO: 168199 - RNA, 1410 nt, Artificial Sequence; identical to SEQ ID NO: 166866
  derived and/or modified sequence opt4 from neuraminidase__InfluenzaA__ABM66999

SEQ ID NO: 168200 - RNA, 1410 nt, Artificial Sequence; identical to SEQ ID NO: 166866
  derived and/or modified sequence opt4 from neuraminidase__InfluenzaA__ABM67010

SEQ ID NO: 168201 - RNA, 1410 nt, Artificial Sequence; identical to SEQ ID NO: 166866
  derived and/or modified sequence opt4 from neuraminidase__InfluenzaA__ABM67021

SEQ ID NO: 168202 - RNA, 1413 nt, Artificial Sequence
  derived and/or modified sequence opt4 from neuraminidase__InfluenzaA__ABM67054
augaaccccaaccagaagaucaucaccaucggcagcaucagcaucgccaucggcaccaucagccugaugcugcagaucggcaacaugaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168203 - RNA, 1350 nt, Artificial Sequence
  derived and/or modified sequence opt4 from neuraminidase__InfluenzaA__ABM68048
augaaccccaaccagaagaucaucaccaucggcagcaucugcauggugaucggcaucgugagccugaugcugcagaucggcaacaucaucagcaucuggaucagccacagcauccagaccggcaaccagugccaggccggccccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagagcuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacagcuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 168204 - RNA, 1350 nt, Artificial Sequence
  derived and/or modified sequence opt4 from neuraminidase__InfluenzaA__ABM68049
augaaccccaaccagaagaucaucaccaucggcagcaucugcauggugaucggcaucgugagccugaugcugcagaucggcaacaucaucagcaucuggaucagccacagcauccagaccggcaaccagugccaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacagcuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 168205 - RNA, 1350 nt, Artificial Sequence
  derived and/or modified sequence opt4 from neuraminidase__InfluenzaA__ABM90436
augaaccccaaccagaagaucaucaccaucggcagcaucugcauggugaucggcaucgugagccugaugcugcagaucggcaacaugaucagcaucugggugagccacagcauccagaagggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagaugaagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 168206 - RNA, 1350 nt, Artificial Sequence; identical to SEQ ID NO: 168205
  derived and/or modified sequence opt4 from neuraminidase__InfluenzaA__ABM90447

SEQ ID NO: 168207 - RNA, 1350 nt, Artificial Sequence; identical to SEQ ID NO: 168205
  derived and/or modified sequence opt4 from neuraminidase__InfluenzaA__ABM90458

SEQ ID NO: 168208 - RNA, 1350 nt, Artificial Sequence; identical to SEQ ID NO: 168205
  derived and/or modified sequence opt4 from neuraminidase__InfluenzaA__ABM90469

SEQ ID NO: 168209 - RNA, 1350 nt, Artificial Sequence
  derived and/or modified sequence opt4 from neuraminidase__InfluenzaA__ABM90491
augaaccccaaccagaagaucaucaccaucggcagcaucugcauggugaucggcaucgugagccugaugcugcagaucggcaacaugaucagcaucugggugagccacagcauccagaagggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagaugaagaagggcaaggugaucaagagcguggagcuggacgccaccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 168210 - RNA, 1350 nt, Artificial Sequence; identical to SEQ ID NO: 168209
  derived and/or modified sequence opt4 from neuraminidase__InfluenzaA__ABM90502

SEQ ID NO: 168211 - RNA, 1350 nt, Artificial Sequence
  derived and/or modified sequence opt4 from neuraminidase__InfluenzaA__ABM90524
augaaccccaaccagaagaucaucaccaucggcagcaucugcauggugaucggcaucgugagccugaugcugcagaucggcaacaugaucagcaucugggugagccacagcauccagaccggcaaccagcaccaggccgagagcaucagcaacaccaacccccugaccgagaaggccguggugagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 168212 - RNA, 1350 nt, Artificial Sequence; identical to SEQ ID NO: 168211
  derived and/or modified sequence opt4 from neuraminidase__InfluenzaA__ABM90535

SEQ ID NO: 168213 - RNA, 1350 nt, Artificial Sequence; identical to SEQ ID NO: 168211
  derived and/or modified sequence opt4 from neuraminidase__InfluenzaA__ABM90546

SEQ ID NO: 168214 - RNA, 1413 nt, Artificial Sequence
  derived and/or modified sequence opt4 from neuraminidase__InfluenzaA__ABN50759
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucagcaacaccaacgugguggccggcaaggacaccaccagcaugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagcagauccugagaacccaggagagcgagugcgugugcgugaacggcagcugcuucaccaucaugaccgacggccccagcgacggccaggccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaucagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 168215 - RNA, 1410 nt, Artificial Sequence
  derived and/or modified sequence opt4 from neuraminidase__InfluenzaA__ABN50770
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168216 - RNA, 1413 nt, Artificial Sequence
  derived and/or modified sequence opt4 from neuraminidase__InfluenzaA__ABN50903
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccgugagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcaacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcggccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucauccagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 168217 - RNA, 1413 nt, Artificial Sequence; identical to SEQ ID NO: 167579
  derived and/or modified sequence opt4 from neuraminidase__InfluenzaA__ABN50920

SEQ ID NO: 168218 - RNA, 1413 nt, Artificial Sequence
  derived and/or modified sequence opt4 from neuraminidase__InfluenzaA__ABN50931
augaaccccaaccagaagaucaucaccaucggcagcaucugcauggccaucggcaucaucagccugauccugcagaucggcaacaucgugagcaucuggaucagccacagcauccagaccggcagccagaacuacaccggcaucugcaaccagagaaucaucaccuacgagaacagcaccugggugaaccagaccuacgugaacaucaacaacaccaacgugguggccggccaggacaccaccagcguggcccuggccggcaacagcagccugugccccaucagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccaacaacggccccgccagcuacaagaucuucaagaucgagaagggcaagaucaccaagagcaucgagcuggacgcccccaacagccacuacgaggagugcagcugcuaccccgacgccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcggccccgugaccguggacggcgccgacggcgugaagggcuucagcuacagauacggcaacggcguguggaucggcagaaccaagagcaacagcagcagaagaggcuucgagaugaucugggaccccaacggcuggaccgacaccgacagcaaguuccuggugaagcaggacgugguggccaucaccgacuggagcggcuacagcggcagcuucgugcagcaccccgagcugaccggccuggacugcaugagacccugcuucuggguggagcugaucagaggcagacccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 168219 - RNA, 1413 nt, Artificial Sequence
  derived and/or modified sequence opt4 from neuraminidase__InfluenzaA__ABN50943
augaaccccaaccagaagaucaucaccaucggcagcaucugcauggccaucggcaucaucagccugauccugcagaucggcaacaucgugagcaucuggaucagccacagcauccagaccggcagccagaacuacaccggcaucugcaaccagagaaucaucaccuacgagaacagcaccugggugaaccagaccuacgugaacaucaacaacaccaacgugguggccggccaggacaccaccagcguggcccuggccggcaacagcagccugugccccaucagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccaacaacggccccgccagcuacaagaucuucaagaucgagaagggcaagaucaccaagagcaucgagcuggacgcccccaacagccacuacgaggagugcagcugcuaccccgacgccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcggccccgugaccguggacggcgccgacggcgugaagggcuucagcuacagauacggcaacggcguguggaucggcagaaccaagagcaacagcagcagaagaggcuucgagaugaucugggaccccaacggcuggaccgacaccgacagcaaguuccuggugaagcaggacgugguggccaugaccgacuggagcggcuacagcggcagcuucgugcagcaccccgagcugaccggccuggacugcaugagacccugcuucuggguggagcugaucagaggcagacccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 168220 - RNA, 1413 nt, Artificial Sequence; identical to SEQ ID NO: 167488
  derived and/or modified sequence opt4 from neuraminidase__InfluenzaA__ABN50954

SEQ ID NO: 168221 - RNA, 1413 nt, Artificial Sequence; identical to SEQ ID NO: 167488
  derived and/or modified sequence opt4 from neuraminidase__InfluenzaA__ABN50965

SEQ ID NO: 168222 - RNA, 1413 nt, Artificial Sequence; identical to SEQ ID NO: 167488
  derived and/or modified sequence opt4 from neuraminidase__InfluenzaA__ABN50976

SEQ ID NO: 168223 - RNA, 1410 nt, Artificial Sequence; identical to SEQ ID NO: 166863
  derived and/or modified sequence opt4 from neuraminidase__InfluenzaA__ABN50987

SEQ ID NO: 168224 - RNA, 1410 nt, Artificial Sequence; identical to SEQ ID NO: 166866
  derived and/or modified sequence opt4 from neuraminidase__InfluenzaA__ABN50998

SEQ ID NO: 168225 - RNA, 1410 nt, Artificial Sequence
  derived and/or modified sequence opt4 from neuraminidase__InfluenzaA__ABN51013
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccugugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168226 - RNA, 1410 nt, Artificial Sequence
  derived and/or modified sequence opt4 from neuraminidase__InfluenzaA__ABN51024
augaaccccaaccagaagaucaucaccaucggcagcgugagccugaccgugagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168227 - RNA, 1410 nt, Artificial Sequence
  derived and/or modified sequence opt4 from neuraminidase__InfluenzaA__ABN51035
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaagaacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168228 - RNA, 1410 nt, Artificial Sequence; identical to SEQ ID NO: 168227
  derived and/or modified sequence opt4 from neuraminidase__InfluenzaA__ABN51046

SEQ ID NO: 168229 - RNA, 1413 nt, Artificial Sequence
  derived and/or modified sequence opt4 from neuraminidase__InfluenzaA__ABN51069
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagauggugugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168230 - RNA, 1413 nt, Artificial Sequence
  derived and/or modified sequence opt4 from neuraminidase__InfluenzaA__ABN51080
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcguggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 168231 - RNA, 1413 nt, Artificial Sequence; identical to SEQ ID NO: 166906
  derived and/or modified sequence opt4 from neuraminidase__InfluenzaA__ABN51091

SEQ ID NO: 168232 - RNA, 1410 nt, Artificial Sequence; identical to SEQ ID NO: 166615
  derived and/or modified sequence opt4 from neuraminidase__InfluenzaA__ABN51102

SEQ ID NO: 168233 - RNA, 1410 nt, Artificial Sequence; identical to SEQ ID NO: 166623
  derived and/or modified sequence opt4 from neuraminidase__InfluenzaA__ABN51113

SEQ ID NO: 168234 - RNA, 1410 nt, Artificial Sequence
  derived and/or modified sequence opt4 from neuraminidase__InfluenzaA__ABN51124
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagagugccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168235 - RNA, 1410 nt, Artificial Sequence; identical to SEQ ID NO: 166623
  derived and/or modified sequence opt4 from neuraminidase__InfluenzaA__ABN51135

SEQ ID NO: 168236 - RNA, 1413 nt, Artificial Sequence; identical to SEQ ID NO: 166916
  derived and/or modified sequence opt4 from neuraminidase__InfluenzaA__ABN51146

SEQ ID NO: 168237 - RNA, 1410 nt, Artificial Sequence
  derived and/or modified sequence opt4 from neuraminidase__InfluenzaA__ABN51157
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgagaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168238 - RNA, 1410 nt, Artificial Sequence; identical to SEQ ID NO: 168226
  derived and/or modified sequence opt4 from neuraminidase__InfluenzaA__ABN59393

SEQ ID NO: 168239 - RNA, 1365 nt, Artificial Sequence
  derived and/or modified sequence opt4 from neuraminidase__InfluenzaA__ABN59415
augaaccccaaccagaagaucaucaccaucggcagcaucugccugguggugggccugaucagccugauccugcagaucggcaacaucaucagcaucuggaucagccacagcauccagaccggcagccagaaccacaccggcaucugcaaccagaacaucaucaccuacaagaacagcaccugggugaaggacaccaccagcgugauccugaccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcagcggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcgccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccgaggacggcaccggcagcugcggccccguguacguggacggcgccaacggcgugaagggcuucagcuacagauacggcaacggcguguggaucggcagaaccaagagccacagcagcagacacggcuucgagaugaucugggaccccaacggcuggaccgagaccgacagcaaguucagcgugagacaggacgugguggccaugaccgacuggagcggcuacagcggcagcuucgugcagcaccccgagcugaccggccuggacugcaugagacccugcuucuggguggagcugaucagaggcagacccaaggagaagaccaucuggaccagcgccagcagcaucagcuucugcggcgugaacagcgacaccguggacuggagcuggcccgacggcgccgagcugcccuucagcaucgacaaguga

SEQ ID NO: 168240 - RNA, 1413 nt, Artificial Sequence; identical to SEQ ID NO: 167471
  derived and/or modified sequence opt4 from neuraminidase__InfluenzaA__ABN59426

SEQ ID NO: 168241 - RNA, 1410 nt, Artificial Sequence; identical to SEQ ID NO: 166773
  derived and/or modified sequence opt4 from neuraminidase__InfluenzaA__ABO32659

SEQ ID NO: 168242 - RNA, 1410 nt, Artificial Sequence
  derived and/or modified sequence opt4 from neuraminidase__InfluenzaA__ABO32670
augaaccccaaccagaagaucaucaccaucggcagcgugagccugaccaucagcaccaucugcuucuucaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccacaugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168243 - RNA, 1413 nt, Artificial Sequence; identical to SEQ ID NO: 168094
  derived and/or modified sequence opt4 from neuraminidase__InfluenzaA__ABO32681

SEQ ID NO: 168244 - RNA, 1410 nt, Artificial Sequence
  derived and/or modified sequence opt4 from neuraminidase__InfluenzaA__ABO32695
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugcagcgaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168245 - RNA, 1410 nt, Artificial Sequence; identical to SEQ ID NO: 167250
  derived and/or modified sequence opt4 from neuraminidase__InfluenzaA__ABO32754

SEQ ID NO: 168246 - RNA, 1410 nt, Artificial Sequence; identical to SEQ ID NO: 167250
  derived and/or modified sequence opt4 from neuraminidase__InfluenzaA__ABO32765

SEQ ID NO: 168247 - RNA, 1410 nt, Artificial Sequence; identical to SEQ ID NO: 168122
  derived and/or modified sequence opt4 from neuraminidase__InfluenzaA__ABO32778

SEQ ID NO: 168248 - RNA, 1410 nt, Artificial Sequence
  derived and/or modified sequence opt4 from neuraminidase__InfluenzaA__ABO32793
augaaccccaaccagaagaucaucaccaucggcagcgugagccugaccaucagcaccaucugcuucuucaugcagaucgugauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaagaccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168249 - RNA, 1410 nt, Artificial Sequence; identical to SEQ ID NO: 166847
  derived and/or modified sequence opt4 from neuraminidase__InfluenzaA__ABO32806

SEQ ID NO: 168250 - RNA, 1410 nt, Artificial Sequence; identical to SEQ ID NO: 167234
  derived and/or modified sequence opt4 from neuraminidase__InfluenzaA__ABO32819

SEQ ID NO: 168251 - RNA, 1410 nt, Artificial Sequence; identical to SEQ ID NO: 166866
  derived and/or modified sequence opt4 from neuraminidase__InfluenzaA__ABO32830

SEQ ID NO: 168252 - RNA, 1410 nt, Artificial Sequence; identical to SEQ ID NO: 167232
  derived and/or modified sequence opt4 from neuraminidase__InfluenzaA__ABO32841

SEQ ID NO: 168253 - RNA, 1410 nt, Artificial Sequence; identical to SEQ ID NO: 167232
  derived and/or modified sequence opt4 from neuraminidase__InfluenzaA__ABO32852

SEQ ID NO: 168254 - RNA, 1410 nt, Artificial Sequence; identical to SEQ ID NO: 167232
  derived and/or modified sequence opt4 from neuraminidase__InfluenzaA__ABO32863

SEQ ID NO: 168255 - RNA, 1410 nt, Artificial Sequence; identical to SEQ ID NO: 168226
  derived and/or modified sequence opt4 from neuraminidase__InfluenzaA__ABO32874

SEQ ID NO: 168256 - RNA, 1410 nt, Artificial Sequence; identical to SEQ ID NO: 168226
  derived and/or modified sequence opt4 from neuraminidase__InfluenzaA__ABO32885

SEQ ID NO: 168257 - RNA, 1410 nt, Artificial Sequence; identical to SEQ ID NO: 168227
  derived and/or modified sequence opt4 from neuraminidase__InfluenzaA__ABO32896

SEQ ID NO: 168258 - RNA, 1410 nt, Artificial Sequence; identical to SEQ ID NO: 168227
  derived and/or modified sequence opt4 from neuraminidase__InfluenzaA__ABO32907

SEQ ID NO: 168259 - RNA, 1410 nt, Artificial Sequence
  derived and/or modified sequence opt4 from neuraminidase__InfluenzaA__ABO32918
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaccugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaacagcaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168260 - RNA, 1410 nt, Artificial Sequence; identical to SEQ ID NO: 168259
  derived and/or modified sequence opt4 from neuraminidase__InfluenzaA__ABO32929

SEQ ID NO: 168261 - RNA, 1410 nt, Artificial Sequence; identical to SEQ ID NO: 168259
  derived and/or modified sequence opt4 from neuraminidase__InfluenzaA__ABO32940

SEQ ID NO: 168262 - RNA, 1413 nt, Artificial Sequence
  derived and/or modified sequence opt4 from neuraminidase__InfluenzaA__ABO32951
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168263 - RNA, 1413 nt, Artificial Sequence
  derived and/or modified sequence opt4 from neuraminidase__InfluenzaA__ABO32962
augaaccccaaccagaagaucaucaccaucggcagcaucagcaucgccaucggcaucaucagccugaugcugcagaucggcaacaucaucagcaucugggccagccacagcauccagaccggcagcaagaaccacaccggcgugugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccaacgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucaagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugagacaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168264 - RNA, 1413 nt, Artificial Sequence; identical to SEQ ID NO: 166906
  derived and/or modified sequence opt4 from neuraminidase__InfluenzaA__ABO32973

SEQ ID NO: 168265 - RNA, 1413 nt, Artificial Sequence; identical to SEQ ID NO: 167471
  derived and/or modified sequence opt4 from neuraminidase__InfluenzaA__ABO32984

SEQ ID NO: 168266 - RNA, 1413 nt, Artificial Sequence; identical to SEQ ID NO: 167471
  derived and/or modified sequence opt4 from neuraminidase__InfluenzaA__ABO32995

SEQ ID NO: 168267 - RNA, 1413 nt, Artificial Sequence
  derived and/or modified sequence opt4 from neuraminidase__InfluenzaA__ABO33009
augaaccccaaccagaagaucaucaccaucggcagcaucugcauggccaucggcaugaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucagcaacaccaacgugguggccggcaaggacaccaccagcaugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagcagauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 168268 - RNA, 1410 nt, Artificial Sequence; identical to SEQ ID NO: 168038
  derived and/or modified sequence opt4 from neuraminidase__InfluenzaA__ABO33039

SEQ ID NO: 168269 - RNA, 1410 nt, Artificial Sequence
  derived and/or modified sequence opt4 from neuraminidase__InfluenzaA__ABO33050
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168270 - RNA, 1410 nt, Artificial Sequence; identical to SEQ ID NO: 167250
  derived and/or modified sequence opt4 from neuraminidase__InfluenzaA__ABO33061

SEQ ID NO: 168271 - RNA, 1410 nt, Artificial Sequence
  derived and/or modified sequence opt4 from neuraminidase__InfluenzaA__ABO33072
augaaccccaaccagaagaucaucaccaucggcagcgugagccugaccaucgccaccaucugcuuccugaugcagaucgccauccuggugaccaccgugacccugcacuucaagcaguacgagugcggcagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 168272 - RNA, 1413 nt, Artificial Sequence; identical to SEQ ID NO: 167579
  derived and/or modified sequence opt4 from neuraminidase__InfluenzaA__ABO37991

SEQ ID NO: 168273 - RNA, 1413 nt, Artificial Sequence
  derived and/or modified sequence opt4 from neuraminidase__InfluenzaA__ABO38013
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuacgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168274 - RNA, 1413 nt, Artificial Sequence
  derived and/or modified sequence opt4 from neuraminidase__InfluenzaA__ABO38024
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacaacaccugggugaaccacaccuacgugaacaucaacaacaccaacaucguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagauggugugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168275 - RNA, 1413 nt, Artificial Sequence
  derived and/or modified sequence opt4 from neuraminidase__InfluenzaA__ABO38035
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaccugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgaggugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggcaugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168276 - RNA, 1413 nt, Artificial Sequence; identical to SEQ ID NO: 166916
  derived and/or modified sequence opt4 from neuraminidase__InfluenzaA__ABO38046

SEQ ID NO: 168277 - RNA, 1413 nt, Artificial Sequence; identical to SEQ ID NO: 167471
  derived and/or modified sequence opt4 from neuraminidase__InfluenzaA__ABO38068

SEQ ID NO: 168278 - RNA, 1410 nt, Artificial Sequence; identical to SEQ ID NO: 166847
  derived and/or modified sequence opt4 from neuraminidase__InfluenzaA__ABO38079

SEQ ID NO: 168279 - RNA, 1410 nt, Artificial Sequence
  derived and/or modified sequence opt4 from neuraminidase__InfluenzaA__ABO38090
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgagagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168280 - RNA, 1410 nt, Artificial Sequence
  derived and/or modified sequence opt4 from neuraminidase__InfluenzaA__ABO38101
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucaacaaggacagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 168281 - RNA, 1410 nt, Artificial Sequence
  derived and/or modified sequence opt4 from neuraminidase__InfluenzaA__ABO38233
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgccagcagcuacgugugcagcggccuggugggcgacacccccagaaagaacgacagauacagcagcagcuacugcagaaaccccaacaacgagaagggcaaccacggcgugaagggcugggccuucgacgacggcaacgacguguggaugggcagaaccaucagcgacgagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 168282 - RNA, 1410 nt, Artificial Sequence; identical to SEQ ID NO: 167631
  derived and/or modified sequence opt4 from neuraminidase__InfluenzaA__ABO38244

SEQ ID NO: 168283 - RNA, 1410 nt, Artificial Sequence; identical to SEQ ID NO: 166847
  derived and/or modified sequence opt4 from neuraminidase__InfluenzaA__ABO38255

SEQ ID NO: 168284 - RNA, 1410 nt, Artificial Sequence; identical to SEQ ID NO: 167232
  derived and/or modified sequence opt4 from neuraminidase__InfluenzaA__ABO38277

SEQ ID NO: 168285 - RNA, 1410 nt, Artificial Sequence; identical to SEQ ID NO: 168259
  derived and/or modified sequence opt4 from neuraminidase__InfluenzaA__ABO38288

SEQ ID NO: 168286 - RNA, 1410 nt, Artificial Sequence
  derived and/or modified sequence opt4 from neuraminidase__InfluenzaA__ABO38299
augaaccccaaccagaagaucaucaccaucggcagcgugagccugaccaucgccaccgugugcuucaucaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggccguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacguggaggagugcagcugcuaccccagauaccccgacgugagaugcaccugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucaacaaggacagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 168287 - RNA, 1410 nt, Artificial Sequence
  derived and/or modified sequence opt4 from neuraminidase__InfluenzaA__ABO38310
augaaccccaaccagaagaucaucaccaucggcagcgugagccugaccaucgccaccgugugcuuccugaugcagaucgccauccuggccaccaccgugacccugcacuucaagcagcacgagugcgacagccccaccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacggcgacagcagcagcaacagcaacugcagagaccccaacaacgagagaggcaaccccggcgugaagggcugggccuucgacaacggcgacgacguguggaugggcagaaccaucaacaaggagagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 168288 - RNA, 1413 nt, Artificial Sequence; identical to SEQ ID NO: 167450
  derived and/or modified sequence opt4 from neuraminidase__InfluenzaA__ABO38332

SEQ ID NO: 168289 - RNA, 1413 nt, Artificial Sequence
  derived and/or modified sequence opt4 from neuraminidase__InfluenzaA__ABO38343
augaaccccaaccagaagaucaucaccaucggcagcaucugcaugaccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcaacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcuggugagaggcagacccagagagggcaccaccguguggaccagcggcagcagcaucagcuucugcggcgugaacagcgacaccgccaacuggagcuggcccgacggcgccgagcugcccuucaccaucgacaaguga

SEQ ID NO: 168290 - RNA, 1410 nt, Artificial Sequence
  derived and/or modified sequence opt4 from neuraminidase__InfluenzaA__ABO38354
augaaccccaaccagaagaucaucaccaucggcagcaucugcaugguggugggcaucaucagccugauccugcagaucggcaacaucaucagcaucuggaucagccacagcauccagaccggcagccagaaccacaccggcaucugcaaccagaacaucaucaccuacaagaacagcaccugggugaaccagaccuacgugaacaucagcaacaccaacgugguggccggccaggacaccaccagcgugauccugaccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacagacacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcgccugcgugaacggcagcugcuucaccaucaugaccgacggccccagcaacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccaaggacggcaccggcagcugcggccccguguacguggacggcgccaacggcgugaagggcuucagcuacagauacggcaacggcguguggaucggcagaaccaagagcaacagcagcagacacggcuucgagaugaucugggaccccaacggcuggaccgagaccgacagcaaguucagcgugagacaggacgugguggccaugaccgacuggagcggcuacagcggcagcuucgugcagcaccccgagcugaccggccuggacugcaugagacccugcuucuggguggagcugaucagaggcagacccaaggagaacaccaucuggaccagcggcagcagcaucagcuucugcggcgugaacagcgacaccguggacuggagcuggcccgacggcgccgagcugcccuucaccaucgacaaguga

SEQ ID NO: 168291 - RNA, 1413 nt, Artificial Sequence
  derived and/or modified sequence opt4 from neuraminidase__InfluenzaA__ABO38365
augaaccccaaccagaagaucaucaccaucggcagcaucugcauggccaucggcaucaucagccugauccugcagaugggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcaacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgccaacuggagcuggcccgacggcgccgagcugcccuucaccaucgacaaguga

SEQ ID NO: 168292 - RNA, 1410 nt, Artificial Sequence
  derived and/or modified sequence opt4 from neuraminidase__InfluenzaA__ABO38376
augaaccccaaccagaagaucaucaccaucggcagcaucugcaugguggugggcaucaucagccugauccugcagaucggcaacaucaucagcaucuggaucagccacagcauccagaccggcagccagaaccacaccggcaccugcaaccagagcaucaucaccuacaagaacagcaccugggugaaccagaccuacgugaacaucagcaacaccaacgugguggccggcaaggacaccaccagcgugauccuggccggcaacagcagccugugccccaucagaggcugggccaucuacagcaaggacaacggcgugagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaaggagauccugagaacccaggagagcgagugcgccugcgugaacggcagcugcuucaccaucaugaccgacggccccagcggcggccccgccagcuacaagaucuucaagaucgagaagggcaaggugaccaagagcaucgagcuggacgcccccaacagccacuacgaggagugcagcugcuaccccgacaccggcaaggugaugugcgugugcagagacaacuggcacggcagcaacagacccugggugagcuucgaccagaaccuggacuaccagaugggcuacaucugcagcggcguguucggcgacaaccccagacccaaggacggcaagggcaacugcggccccguguacguggacggcgccaacggcgugaagggcuucagcuacagauacggcaacggcguguggaucggcagaaccaagagcaacagcagcagacagggcuucgagaugaucugggaccccaacggcuggaccgagaccgacagcaacuucuucgugaagcaggacgugguggccgugaccgacuggagcggcuacagcggcagcuucgugcagcaccccgagcugaccggccuggacugcaugagacccugcuucuggguggagcugaucagaggcagacccaaggagaagaccaucuggaccagcggcagcagcaucagcuucugcggcgugaacagcgacaccguggacuggagcuggcccgacggcgccgagcugcccuucaccaucgacaaguga

SEQ ID NO: 168293 - RNA, 1410 nt, Artificial Sequence
  derived and/or modified sequence opt4 from neuraminidase__InfluenzaA__ABO38387
augaaccccaaccagaagaucaucaccaucggcagcaucugcaugguggugggcaucaucagccugauccugcagaucggcaacaucaucagcaucuggaucagccacagcauccagaccggcagccagaaccacaccggcaucugcaaccagagcaucaucaccuacaagaacagcaccugggugaaccagaccuacgugaacaucagcaacaccaacgugguggccggccaggacaccaccagcgugauccugaccggcaacagcagccugugccccaucagaggcugggccaucuacagcaaggacaacggcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacgaggccguggccgugcugaaguacaacggcaucaucaccgagaccaucaagagcuggagaaagaagauccugagaacccaggagagcgagugcgccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccaaggacggcaccggcagcugcggccccguguacguggacggcgccaacggcgugaagggcuucagcuacagauacggcaacggcguguggaucggcagaaccaagagcaccagcagcagacacggcuucgagaugaucugggaccccaacggcuggaccgagaccgacagcaaguucagcgugagacaggacgugguggccaugaccgacuggagcggcuacagcggcagcuucgugcagcaccccgagcugaccggccuggacugcaugagacccugcuucuggguggagcugaucagaggccagcccaaggagaagaccaucuggaccagcggcagcagcaucagcuucugcggcgugaacagcgacaccguggacuggagcuggcccgacggcgccgagcugcccuucaccaucgacaaguga

SEQ ID NO: 168294 - RNA, 1413 nt, Artificial Sequence
  derived and/or modified sequence opt4 from neuraminidase__InfluenzaA__ABO38398
augaaccccaaccagaagaucaucaccaucggcagcaucugcauggccaucggcaucaucagccugauccugcagaucggcaacaucgugagcaucuggaucagccacagcauccagaccggcagccagaacuacaccggcaucugcaaccagagaaucaucaccuacgagaacagcaccugggugaaccagaccuacgugaacaucaacaacaccaacgugguggccggccaggacaccaccagcguggcccuggccggcaacagcagccugugccccaucagcggcugggccaucuacagcaaggacaacagcaucagaaucggcagcaagggcgacguguucgugaucagagagcccuucaucagcugcagccaccuggagugcagaaacuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccaacaacggccccgccagcuacaagaucuucaagaucgagaagggcaagaucaccaagagcaucgagcuggacgcccccaacagccacuacgaggagugcagcugcuaccccgacgccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagcagcagaagaggcuucgagaugaucugggaccccaacggcuggaccgacaccgacagcaaguuccuggugaagcaggacgugguggccaugaccgacuggagcggcuacagcggcagcuucgugcagcaccccgagcugaccggccuggacugcaugagacccugcuucuggguggagcugaucagaggcagacccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 168295 - RNA, 1410 nt, Artificial Sequence; identical to SEQ ID NO: 166773
  derived and/or modified sequence opt4 from neuraminidase__InfluenzaA__ABO38420

SEQ ID NO: 168296 - RNA, 1410 nt, Artificial Sequence
  derived and/or modified sequence opt4 from neuraminidase__InfluenzaA__ABO38715
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaccugccccaaggugguggaguacagaagcuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccaucguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168297 - RNA, 1410 nt, Artificial Sequence; identical to SEQ ID NO: 168296
  derived and/or modified sequence opt4 from neuraminidase__InfluenzaA__ABO38726

SEQ ID NO: 168298 - RNA, 1413 nt, Artificial Sequence
  derived and/or modified sequence opt4 from neuraminidase__InfluenzaA__ABO44049
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaucugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168299 - RNA, 1410 nt, Artificial Sequence
  derived and/or modified sequence opt4 from neuraminidase__InfluenzaA__ABO44060
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaaccugaugcccaucuga

SEQ ID NO: 168300 - RNA, 1410 nt, Artificial Sequence
  derived and/or modified sequence opt4 from neuraminidase__InfluenzaA__ABO44071
augaaccccaaccagaagaucaucaccaucggcuucguguuccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcaagaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168301 - RNA, 1410 nt, Artificial Sequence; identical to SEQ ID NO: 166866
  derived and/or modified sequence opt4 from neuraminidase__InfluenzaA__ABO44082

SEQ ID NO: 168302 - RNA, 1410 nt, Artificial Sequence
  derived and/or modified sequence opt4 from neuraminidase__InfluenzaA__ABO44093
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugcuggacaucagcauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaagccaggagaccagagugugguggaccagcaacagcaucgugguguucugcggcaccagcggcaccuacggcaccggcagcuggcccgacggcgccaacaucaacuucaugcccaucuga

SEQ ID NO: 168303 - RNA, 1410 nt, Artificial Sequence
  derived and/or modified sequence opt4 from neuraminidase__InfluenzaA__ABO44104
augaaccccaaccagaagaucaucaccaucggcagcgccagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagaagggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaaccugaugcccaucuga

SEQ ID NO: 168304 - RNA, 1413 nt, Artificial Sequence
  derived and/or modified sequence opt4 from neuraminidase__InfluenzaA__ABO44126
augaaccccaaccagaagaucaucaccaucggcagcaucugcauggccaucggcaucaucagccugauccugcagaucggcaacaucgugagcaucuggaucagccacagcauccagaccggcagccagaacuacaccggcaucugcaaccagagaaucaucaccuacgagaacagcaccugggugaaccagaccuacgugaacaucaacaacaccaacgugguggccggccaggacaccaccagcguggcccuggccggcaacagcagccugugccccaucagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccaacaacggccccgccagcuacaagaucuucaagaucgagaagggcaagaucaccaagagcaucgagcugaacgcccccaacagccacuacgaggagugcagcugcuaccccgacgccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcggccccgugaccguggacggcgccgacggcgugaagggcuucagcuacagauacggcaacggcguguggaucggcagaaccaagagcaacagcagcagaagaggcuucgagaugaucugggaccccaacggcuggaccgacaccgacagcaaguuccuggugaagcaggacgugguggccaucaccgacuggagcggcuacagcggcagcuucgugcagcaccccgagcugaccggccuggacugcaugagacccugcuucuggguggagcugaucagaggcagacccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 168305 - RNA, 1413 nt, Artificial Sequence
  derived and/or modified sequence opt4 from neuraminidase__InfluenzaA__ABO52228
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168306 - RNA, 1410 nt, Artificial Sequence
  derived and/or modified sequence opt4 from neuraminidase__InfluenzaA__ABO52239
augaaccccaaccagaagaucaucaccaucggcagcgugagccugaccaucgccaccgugugcuucaucaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggccguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucaacaaggacagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 168307 - RNA, 1410 nt, Artificial Sequence; identical to SEQ ID NO: 168303
  derived and/or modified sequence opt4 from neuraminidase__InfluenzaA__ABO52250

SEQ ID NO: 168308 - RNA, 1413 nt, Artificial Sequence
  derived and/or modified sequence opt4 from neuraminidase__InfluenzaA__ABO52261
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcaacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagcagcagaaagggcuucgagaugaucugggaccccgacggcuggaccgacaccgacagcaacuuccuggugaagcaggacgugguggccaugaccgacuggagcggcuacagcggcagcuucgugcagcaccccgagcugaccggccuggacugcaucagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 168309 - RNA, 1413 nt, Artificial Sequence
  derived and/or modified sequence opt4 from neuraminidase__InfluenzaA__ABO52283
augaaccccaaccagaagaucaucaccaucggcagcaucugcaugaccaucggcaccaucagccugauccugcagaucggcaacaucaucagcaucuggaucagccacagcauccagaccggcagccagaaccacaccggcaucugcaaccagagaaucaucaccuacgagaacaacaccugggugaaccagaccuacgugaacaucagcaacaccaacgugguggccggcaaggacaccaccagcaugauccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaucaucaagagcuggagaaagcagauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaaggugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcgacggcguguggaucggcagaaccaagagcaacagcagcagaaagggcuucgagaugaucugggaccccaacggcuggaccgacaccgacgacaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacauguga

SEQ ID NO: 168310 - RNA, 1410 nt, Artificial Sequence; identical to SEQ ID NO: 168038
  derived and/or modified sequence opt4 from neuraminidase__InfluenzaA__ABO52294

SEQ ID NO: 168311 - RNA, 1410 nt, Artificial Sequence
  derived and/or modified sequence opt4 from neuraminidase__InfluenzaA__ABO52316
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccagaucaugcccugcgagcccaccaucaucgagagaaacaucaccgagaucguguaccugaccaacaucaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccagcagaugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaagaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcgccggcagcuggcccgacggcgccgacaucaaccugaugcccaucuga

SEQ ID NO: 168312 - RNA, 1410 nt, Artificial Sequence; identical to SEQ ID NO: 166634
  derived and/or modified sequence opt4 from neuraminidase__InfluenzaA__ABO52327

SEQ ID NO: 168313 - RNA, 1410 nt, Artificial Sequence
  derived and/or modified sequence opt4 from neuraminidase__InfluenzaA__ABO52338
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcagcagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 168314 - RNA, 1410 nt, Artificial Sequence
  derived and/or modified sequence opt4 from neuraminidase__InfluenzaA__ABO52349
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacgugaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucauccacaucagcccccugagcggcagcgcccagcacguggaggagugcagcugcuaccccagauaccccggcgugagaugcaucugcagagacaacuggaagggcagcaacagacccgugguggacaucaacaugagagacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcaacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 168315 - RNA, 1410 nt, Artificial Sequence
  derived and/or modified sequence opt4 from neuraminidase__InfluenzaA__ABO52360
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcaacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 168316 - RNA, 1410 nt, Artificial Sequence
  derived and/or modified sequence opt4 from neuraminidase__InfluenzaA__ABO52371
augaaccccaaccagaagaucaucaccaucggcagcgugagccugaccaucgccaccgugugcuuccugaugcagaucgccauccuggugaccaccgugacccugcacuucagacaguacgagugcgacagccccgccaacaaccaggugaugcccugcgagcccaucaucaucgagagaaacaucaccgagaucguguaccugaacaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcaagcugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacguggaggacuacagcaucgacagcagcuacgugugcagcggccuggugggcgacacccccagaaacaacgacagaagcggcaacagcaacugcagaaaccccaacaacgagagaggcaaccacggcgugaagggcugggccuucgacgacggcaacgacguguggaugggcagaaccaucaacaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 168317 - RNA, 1413 nt, Artificial Sequence
  derived and/or modified sequence opt4 from neuraminidase__InfluenzaA__ABO52800
augaaccccaaccagaagaucaucaccaucggcagcaucugcaugaccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcaacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagagaaccaccaucuggaccagcggcagcagcaucagcuucugcggcgugaacagcgacaccgccaacuggagcuggcccgacggcgccgagcugcccuucaccaucgacaaguga

SEQ ID NO: 168318 - RNA, 1413 nt, Artificial Sequence; identical to SEQ ID NO: 167348
  derived and/or modified sequence opt4 from neuraminidase__InfluenzaA__ABP49220

SEQ ID NO: 168319 - RNA, 1413 nt, Artificial Sequence
  derived and/or modified sequence opt4 from neuraminidase__InfluenzaA__ABP49319
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacaacaccugggugaaccagaccuacgugaacaucagcaacaccaacgugguggccggcaaggacaccaccagcaugauccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagcagauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaaggugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacggcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 168320 - RNA, 1410 nt, Artificial Sequence
  derived and/or modified sequence opt4 from neuraminidase__InfluenzaA__ABP49330
augaaccccaaccagaagaucaucaccaucggcagcaucugcaugguggugggcaucaucagccugauccugcagaucggcaacaucaucagcaucuggaucagccacagcauccagaccggcagccagaaccacaccggcaucugcaaccagagcaucaucaccuacaagaacagcaccugggugaaccagaccuacgugaacaucagcaacaccaacgugguggccggcaagggcaccacccccgugauccuggccggcaacagcagccugugccccaucagaggcugggccaucuacagcaaggacaacggcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccugcgccugccacgacggcaugggcuggcugaccaucggcaucagcggccccgacgacgaggccguggccgugcugaaguacaacggcaucaucaccgagaccaucaagagcuggagaaagaagauccugagaacccaggagagcgagugcgugugcgugaacggcagcugcuucaccaucaugaccgacggccccagcgacggccccgccagcuacaagaucuucaagaucgagaagggcaaggugaccaagagcaucgagcuggacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccaaggacggcaagggcagcugcggccccguguacguggacggcgccaacggcgugaagggcuucagcuacagauacggcaacggcguguggaucggcagaaucaagagcaacagcagcagacagggcuucgagaugaucugggaccccaacggcuggaccgagaccgacagcagcuucuucgugaagcaggacgugguggccaugaccgacuggagcggcuacagcggcagcuucgugcagcaccccgagcugaccggccuggacugcaugagacccugcuucuggguggagcugaucagaggcagacccaaggagaagaccaucuggaccagcggcagcagcaucagcuucugcggcgugaacagcgacaccguggacuggagcuggcccgacggcgccgagcugcccuucaccaucgacaaguga

SEQ ID NO: 168321 - RNA, 1413 nt, Artificial Sequence
  derived and/or modified sequence opt4 from neuraminidase__InfluenzaA__ABP49352
augaaccccaaccagaagaucaucaccaucggcagcaucugcaugaccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaccaccagcguggcccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcggccccgugaccguggacggcgccgacggcgugaagggcuucagcuacaaguacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagagaaccaccaucuggaccagcggcagcagcaucagcuucugcggcguggacagcgacaccgccaacuggagcuggcccgacggcgccgagcugcccuucaccaucgacaaguga

SEQ ID NO: 168322 - RNA, 1413 nt, Artificial Sequence; identical to SEQ ID NO: 168218
  derived and/or modified sequence opt4 from neuraminidase__InfluenzaA__ABP49363

SEQ ID NO: 168323 - RNA, 1410 nt, Artificial Sequence; identical to SEQ ID NO: 167250
  derived and/or modified sequence opt4 from neuraminidase__InfluenzaA__ABP49374

SEQ ID NO: 168324 - RNA, 1413 nt, Artificial Sequence
  derived and/or modified sequence opt4 from neuraminidase__InfluenzaA__ABP49385
augaaccccaaccagaagaucaucaccaucggcagcaucagcguggccaucggcaucaucaaccugacccugcagaucggcaacaucaucagcaucugggccagccacagcauccagaccggcagccagaacuacaccggcaucugcaaccagagaaucaucaccuacgagaacagaaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuucagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 168325 - RNA, 1413 nt, Artificial Sequence; identical to SEQ ID NO: 166906
  derived and/or modified sequence opt4 from neuraminidase__InfluenzaA__ABP49396

SEQ ID NO: 168326 - RNA, 1410 nt, Artificial Sequence
  derived and/or modified sequence opt4 from neuraminidase__InfluenzaA__ABP49407
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugagcgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagaucugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168327 - RNA, 1410 nt, Artificial Sequence; identical to SEQ ID NO: 167250
  derived and/or modified sequence opt4 from neuraminidase__InfluenzaA__ABP49418

SEQ ID NO: 168328 - RNA, 1410 nt, Artificial Sequence; identical to SEQ ID NO: 167250
  derived and/or modified sequence opt4 from neuraminidase__InfluenzaA__ABP49429

SEQ ID NO: 168329 - RNA, 1410 nt, Artificial Sequence
  derived and/or modified sequence opt4 from neuraminidase__InfluenzaA__ABP49440
augaaccccaaccagaagaucaucaccaucggcagcgugagccugaccaucgccaccgugugcuuccugauccagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggacagcagaagcggcuacgagaccuucaaggugaucggcggcuggagcacccccaacagcaagagccaggccaacagacaggugaucguggacaagaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 168330 - RNA, 1413 nt, Artificial Sequence; identical to SEQ ID NO: 167471
  derived and/or modified sequence opt4 from neuraminidase__InfluenzaA__ABP49451

SEQ ID NO: 168331 - RNA, 1410 nt, Artificial Sequence
  derived and/or modified sequence opt4 from neuraminidase__InfluenzaA__ABP49462
augaaccccaaccagaagaucaucaccaucggcagcgugagccugaccaucgccaccgugugcuucaucaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggccguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucaacaaggacagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 168332 - RNA, 1410 nt, Artificial Sequence; identical to SEQ ID NO: 168280
  derived and/or modified sequence opt4 from neuraminidase__InfluenzaA__ABP49473

SEQ ID NO: 168333 - RNA, 1410 nt, Artificial Sequence
  derived and/or modified sequence opt4 from neuraminidase__InfluenzaA__ABP49495
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaccagcccccugagcggcagcgcccagcacguggaggagugcagcugcuaccccagauaccccggcgugagaugcaucugcagagacaacuggagaggcagcaacagacccgugguggacaucaacgugaaggacuacagcaucgacagcagcuacgugugcagcggccuggugggcgacacccccagaaacaacgacagaagcagcagcagcuacugcagaaaccccaacaacgagaagggcacccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 168334 - RNA, 1410 nt, Artificial Sequence; identical to SEQ ID NO: 166623
  derived and/or modified sequence opt4 from neuraminidase__InfluenzaA__ABP49506

SEQ ID NO: 168335 - RNA, 1410 nt, Artificial Sequence; identical to SEQ ID NO: 166615
  derived and/or modified sequence opt4 from neuraminidase__InfluenzaA__ABP49517

SEQ ID NO: 168336 - RNA, 1413 nt, Artificial Sequence
  derived and/or modified sequence opt4 from neuraminidase__InfluenzaA__ABQ01314
augaaccccaaccagaagaucaucaccaucggcagcaucugcauggccaucggcaccaucagccugauccugcagaucggcaacaucaucagcaucugggugagccacagcauccagaccggcagccagaaccacaccggcaucugcaaccagagaaucaucaccuacgagaacaacaccugggugaaccagaccuacgugaacaucagcaacaccaacgugguggccggcaaggacaccaccagcaugauccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaucaucaagagcuggagaaagcagauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaaggugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacggcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 168337 - RNA, 1413 nt, Artificial Sequence
  derived and/or modified sequence opt4 from neuraminidase__InfluenzaA__ABQ01325
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucagcaacaccaacgugguggccggcaaggacaccaccagcaugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagcagauccugagaacccaggagagcgagugcgugugcgugaacggcagcugcuucaccaucaugaccgacggccccagcgacggccaggccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 168338 - RNA, 1410 nt, Artificial Sequence; identical to SEQ ID NO: 167250
  derived and/or modified sequence opt4 from neuraminidase__InfluenzaA__ABQ01336

SEQ ID NO: 168339 - RNA, 1410 nt, Artificial Sequence; identical to SEQ ID NO: 167250
  derived and/or modified sequence opt4 from neuraminidase__InfluenzaA__ABQ01347

SEQ ID NO: 168340 - RNA, 1410 nt, Artificial Sequence
  derived and/or modified sequence opt4 from neuraminidase__InfluenzaA__ABQ01358
augaaccccaaccagaagaucaucaccaucggcagcgugagccugaccaucgccaccgugugcuuccugaugcagaucgccauccuggccaccaccgugacccugcacuucaagcagcacgagugcaacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacuggaggacagcaucggcagcuggagccagaacauccugagaacccaggagagcgagugcgugugcaucaacggcaccugcaccguggugaugaccgacggcaacgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugcuggacaucagcauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaagccaggagaccagagugugguggaccagcaacagcaucgugguguucugcggcaccagcggcaccuacggcaccggcagcuggcccgacggcgccaacaucaacuucaugcccaucuga

SEQ ID NO: 168341 - RNA, 1410 nt, Artificial Sequence
  derived and/or modified sequence opt4 from neuraminidase__InfluenzaA__ABQ01369
augaaccccaaccagaagaucaucaccaucggcagcgugagccugaccaucgccaccaucugcuucgugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaccagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaagaacgacagaagcagcagcagcuacugcagaaaccccaacaacgagaagggcacccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 168342 - RNA, 1410 nt, Artificial Sequence
  derived and/or modified sequence opt4 from neuraminidase__InfluenzaA__ABQ44386
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaacgaggugcuguggaccagcaacagcaucgugguguucugcggcaccagcggcaccuacggcaccggcagcuggcccgacggcgccgacaucaaccugaugcccaucuga

SEQ ID NO: 168343 - RNA, 1410 nt, Artificial Sequence; identical to SEQ ID NO: 167234
  derived and/or modified sequence opt4 from neuraminidase__InfluenzaA__ABQ44408

SEQ ID NO: 168344 - RNA, 1413 nt, Artificial Sequence
  derived and/or modified sequence opt4 from neuraminidase__InfluenzaA__ABQ44419
augaaccccaaccagaagaucaucaccaucggcagcaucugcauggccaucggcaucaucagccugauccugcagaucggcaacaucgugagcaucuggaucagccacagcauccagaacggcagccagaacuacaccggcaucugcaaccagagaaucaucaccuacgagaacagcaccugggugaaccagaccuacgugaacaucaacaacaccaacgugguggccggccaggacaccaccagcguggcccuggccggcaacagcagccugugccccaucagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccaacaacggccccgccagcuacaagaucuucaagaucgagaagggcaagaucaccaagagcaucgagcuggacgcccccaacagccacuacgaggagugcagcugcuaccccgacgccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcggccccgugaccguggacggcgccgacggcgugaagggcuucagcuacagauacggcaacggcguguggaucggcagaaccaagagcaacagcagcagaagaggcuucgagaugaucugggaccccaacggcuggaccgacaccgacagcaaguuccuggugaagcaggacgugguggccaugaccgacuggagcggcuacagcggcagcuucgugcagcaccccgagcugaccggccuggacugcaugagacccugcuucuggguggagcugaucagaggcagacccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 168345 - RNA, 1410 nt, Artificial Sequence; identical to SEQ ID NO: 166866
  derived and/or modified sequence opt4 from neuraminidase__InfluenzaA__ABQ44430

SEQ ID NO: 168346 - RNA, 1410 nt, Artificial Sequence; identical to SEQ ID NO: 168296
  derived and/or modified sequence opt4 from neuraminidase__InfluenzaA__ABQ44441

SEQ ID NO: 168347 - RNA, 1410 nt, Artificial Sequence; identical to SEQ ID NO: 168280
  derived and/or modified sequence opt4 from neuraminidase__InfluenzaA__ABQ44463

SEQ ID NO: 168348 - RNA, 1413 nt, Artificial Sequence
  derived and/or modified sequence opt4 from neuraminidase__InfluenzaA__ABQ44474
augaaccccaaccagaagaucaucaccaucggcagcaucugcaugaccaucggcaccaucagccugauccugcagaucggcaacaucaucagcaucugggugagccacagcauccagaccggcagccagaaccacaccggcaucugcaaccagagaaucaucaccuacgagaacaacaccugggugaaccagaccuacgugaacaucagcaacaccaacgugguggccggcaaggacaccaccagcaugauccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaucaucaagagcuggagaaagcagauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaaggugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacggcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 168349 - RNA, 1410 nt, Artificial Sequence; identical to SEQ ID NO: 166615
  derived and/or modified sequence opt4 from neuraminidase__InfluenzaA__ABR15800

SEQ ID NO: 168350 - RNA, 1413 nt, Artificial Sequence; identical to SEQ ID NO: 168336
  derived and/or modified sequence opt4 from neuraminidase__InfluenzaA__ABR15811

SEQ ID NO: 168351 - RNA, 1413 nt, Artificial Sequence; identical to SEQ ID NO: 167348
  derived and/or modified sequence opt4 from neuraminidase__InfluenzaA__ABR15910

SEQ ID NO: 168352 - RNA, 1410 nt, Artificial Sequence; identical to SEQ ID NO: 166674
  derived and/or modified sequence opt4 from neuraminidase__InfluenzaA__ABR15932

SEQ ID NO: 168353 - RNA, 1410 nt, Artificial Sequence
  derived and/or modified sequence opt4 from neuraminidase__InfluenzaA__ABR15943
augaaccccaaccagaagaucaucaccaucggcagcgugagccugaccaucgccaccaucugcuuccugaugcagaucgccauccuggugaccaccgugacccugcacuucagacaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168354 - RNA, 1410 nt, Artificial Sequence
  derived and/or modified sequence opt4 from neuraminidase__InfluenzaA__ABR15954
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacaacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168355 - RNA, 1410 nt, Artificial Sequence; identical to SEQ ID NO: 166674
  derived and/or modified sequence opt4 from neuraminidase__InfluenzaA__ABR15965

SEQ ID NO: 168356 - RNA, 1410 nt, Artificial Sequence
  derived and/or modified sequence opt4 from neuraminidase__InfluenzaA__ABR22243
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgaccugaaccugaugcccaucuga

SEQ ID NO: 168357 - RNA, 1410 nt, Artificial Sequence; identical to SEQ ID NO: 167250
  derived and/or modified sequence opt4 from neuraminidase__InfluenzaA__ABR28518

SEQ ID NO: 168358 - RNA, 1410 nt, Artificial Sequence; identical to SEQ ID NO: 167096
  derived and/or modified sequence opt4 from neuraminidase__InfluenzaA__ABR28595

SEQ ID NO: 168359 - RNA, 1413 nt, Artificial Sequence
  derived and/or modified sequence opt4 from neuraminidase__InfluenzaA__ABR28771
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcagagagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168360 - RNA, 1413 nt, Artificial Sequence
  derived and/or modified sequence opt4 from neuraminidase__InfluenzaA__ABR28782
augaaccccaaccagaagaucaucaccaucggcagcaucagcaucgccaucggcauccugagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168361 - RNA, 1410 nt, Artificial Sequence; identical to SEQ ID NO: 167364
  derived and/or modified sequence opt4 from neuraminidase__InfluenzaA__ABR28793

SEQ ID NO: 168362 - RNA, 1413 nt, Artificial Sequence; identical to SEQ ID NO: 167348
  derived and/or modified sequence opt4 from neuraminidase__InfluenzaA__ABR28804

SEQ ID NO: 168363 - RNA, 1410 nt, Artificial Sequence; identical to SEQ ID NO: 167250
  derived and/or modified sequence opt4 from neuraminidase__InfluenzaA__ABR28815

SEQ ID NO: 168364 - RNA, 1410 nt, Artificial Sequence; identical to SEQ ID NO: 166674
  derived and/or modified sequence opt4 from neuraminidase__InfluenzaA__ABR28826

SEQ ID NO: 168365 - RNA, 1413 nt, Artificial Sequence; identical to SEQ ID NO: 166916
  derived and/or modified sequence opt4 from neuraminidase__InfluenzaA__ABR28837

SEQ ID NO: 168366 - RNA, 1413 nt, Artificial Sequence
  derived and/or modified sequence opt4 from neuraminidase__InfluenzaA__ABR28848
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgugggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaagaucaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagauggugugggaccccaacggcuggaccgacaccgacagcgacuucagcgugaagcaggacgugguggccaucaccgacuggagcggcuacagcggcagcuucgugcagcaccccgagcugaccggccugaacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 168367 - RNA, 1410 nt, Artificial Sequence
  derived and/or modified sequence opt4 from neuraminidase__InfluenzaA__ABR28859
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacggcagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168368 - RNA, 1410 nt, Artificial Sequence
  derived and/or modified sequence opt4 from neuraminidase__InfluenzaA__ABR28870
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaccguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168369 - RNA, 1410 nt, Artificial Sequence
  derived and/or modified sequence opt4 from neuraminidase__InfluenzaA__ABR28881
augaaccccaaccagaagaucaucaccaucggcagcgugagccugaccaucgccaccgugugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168370 - RNA, 1410 nt, Artificial Sequence; identical to SEQ ID NO: 167234
  derived and/or modified sequence opt4 from neuraminidase__InfluenzaA__ABR28892

SEQ ID NO: 168371 - RNA, 1413 nt, Artificial Sequence; identical to SEQ ID NO: 166906
  derived and/or modified sequence opt4 from neuraminidase__InfluenzaA__ABR28903

SEQ ID NO: 168372 - RNA, 1410 nt, Artificial Sequence
  derived and/or modified sequence opt4 from neuraminidase__InfluenzaA__ABR28925
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggaggugcugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168373 - RNA, 1410 nt, Artificial Sequence
  derived and/or modified sequence opt4 from neuraminidase__InfluenzaA__ABR88082
auggaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaucaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaagaacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168374 - RNA, 1413 nt, Artificial Sequence
  derived and/or modified sequence opt4 from neuraminidase__InfluenzaA__ABS00324
augaaccccaaccagaagaucaucaccaucggcagcaucugcauggccaucggcaucaucagccugauccugcagaucggcaacaucgugagcaucuggaucagccacagcauccagaccggcagccagaacuacaccggcaucugcaaccagagaaucaucaccuacgagaacagcaccugggugaaccagaccuacgugaacaucaacaacaccaacgugguggccggccaggacaccaccagcguggcccuggccggcaacagcagccugugccccaucagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccaacaacggccccgccagcuacaagaucuucaagaucgagaagggcaagaucaccaagagcaucgagcuggacgcccccaacagccacuacgaggagugcagcugcuaccccgacgccggcaccgugaugugcgugugcagagacaacuggagaggcagcaacagacccugggugagcuucaaccagagccuggacuaccagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagcagcagaagaggcuucgagaugaucugggaccccaacggcuggaccgacaccgacagcaaguuccuggugaagcaggacgugguggccaugaccgacuggagcggcuacagcggcagcuucgugcagcaccccgagcugaccggccuggacugcaugagacccugcuucuggguggagcugaucagaggcagacccagagagaacaccaccaucuggaccagcggcagcagcaucagcuucugcggcgugaacggcgacaccgccaacuggagcuggcccgacggcagcgagcugcccuucaccaucgacaaguga

SEQ ID NO: 168375 - RNA, 1410 nt, Artificial Sequence; identical to SEQ ID NO: 166634
  derived and/or modified sequence opt4 from neuraminidase__InfluenzaA__ABS49902

SEQ ID NO: 168376 - RNA, 1410 nt, Artificial Sequence
  derived and/or modified sequence opt4 from neuraminidase__InfluenzaA__ABS49913
augaaccccaaccagaagaucaucaccaucggcagcgugagccugaccaucgccaccgugugcuuccugaugcagaucgccauccuggugaccaccgugacccugcacuucagacaguacgagugcgacagccccaccaacaaccaggugaugcccugcgagcccaucaucaucgagagaaacaucaccgagaucguguaccugaacaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacguggaggacuacagcaucgacagcagcuacgugugcagcggccuggugggcgacacccccagaaacaacgacagaagcagcaacagcaacugcagaaaccccaacaacgagagaggcaaccacggcgugaagggcugggccuucgacgacggcaacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 168377 - RNA, 1410 nt, Artificial Sequence; identical to SEQ ID NO: 167364
  derived and/or modified sequence opt4 from neuraminidase__InfluenzaA__ABS49968

SEQ ID NO: 168378 - RNA, 1413 nt, Artificial Sequence; identical to SEQ ID NO: 168360
  derived and/or modified sequence opt4 from neuraminidase__InfluenzaA__ABS49979

SEQ ID NO: 168379 - RNA, 1413 nt, Artificial Sequence
  derived and/or modified sequence opt4 from neuraminidase__InfluenzaA__ABS49990
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugauccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168380 - RNA, 1410 nt, Artificial Sequence; identical to SEQ ID NO: 167250
  derived and/or modified sequence opt4 from neuraminidase__InfluenzaA__ABS50001

SEQ ID NO: 168381 - RNA, 1410 nt, Artificial Sequence; identical to SEQ ID NO: 167250
  derived and/or modified sequence opt4 from neuraminidase__InfluenzaA__ABS50012

SEQ ID NO: 168382 - RNA, 1410 nt, Artificial Sequence
  derived and/or modified sequence opt4 from neuraminidase__InfluenzaA__ABS50023
augaaccccaaccagaagaucaucaccaucggcagcgugagccugaccaucgccaccaucugcuuccugaugcagaucgccgugcuggugaccaccgugacccugcacuucaagcaguacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaucgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168383 - RNA, 1410 nt, Artificial Sequence; identical to SEQ ID NO: 167250
  derived and/or modified sequence opt4 from neuraminidase__InfluenzaA__ABS50034

SEQ ID NO: 168384 - RNA, 1410 nt, Artificial Sequence
  derived and/or modified sequence opt4 from neuraminidase__InfluenzaA__ABS50045
augaaccccaaccagaagaucaucaccaucggcagcgugagccugaccaucgccaccaucugcuuccugaugcagaccgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168385 - RNA, 1410 nt, Artificial Sequence; identical to SEQ ID NO: 166674
  derived and/or modified sequence opt4 from neuraminidase__InfluenzaA__ABS50056

SEQ ID NO: 168386 - RNA, 1410 nt, Artificial Sequence; identical to SEQ ID NO: 166700
  derived and/or modified sequence opt4 from neuraminidase__InfluenzaA__ABS50067

SEQ ID NO: 168387 - RNA, 1410 nt, Artificial Sequence; identical to SEQ ID NO: 167234
  derived and/or modified sequence opt4 from neuraminidase__InfluenzaA__ABS50078

SEQ ID NO: 168388 - RNA, 1413 nt, Artificial Sequence
  derived and/or modified sequence opt4 from neuraminidase__InfluenzaA__ABS71644
augaagcccaaccagaagaucaucaccaucggcagcaucagcaucgccaucggcaucaucagccugauccugcagaucggcaacaucaucagcaucugggccagccacagcauccagaccgagagccagaaccacaccggcaucugcaaccagagaaucaucaccuacgagaacagcaccugggugaacaacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagaccauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaugggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcaccgccaacuggagcuggcccgacggcgccgagcugcccuucaccaucgacaaguga

SEQ ID NO: 168389 - RNA, 1413 nt, Artificial Sequence
  derived and/or modified sequence opt4 from neuraminidase__InfluenzaA__ABS71646
augaaccccaaccagaagaucaucaccaucggcagcaucagcaucgccaucggcaucaucagccugauccugcagaucggcaacaucaucagcaucugggccagccacagcauccagaccgagagccagaaccacaccggcaucugcaaccagagaaucaucaccuacgagaacagcaccugggugaacaacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagaccauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaugggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcaccgccaacuggagcuggcccgacggcgccgagcugcccuucaccaucgacaaguga

SEQ ID NO: 168390 - RNA, 1413 nt, Artificial Sequence
  derived and/or modified sequence opt4 from neuraminidase__InfluenzaA__ABS71647
augaaccccaaccagaagaucaucaccaucggcagcaucagcaucgccaucggcaucaucagccugauccugcagaucggcaacaucaucagcaucugggccagccacagcauccagaccgagagccagaaccacaccggcaucugcaaccagagaaucaucaccuacgagaacagcaccugggugaacaacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagagaauccugagaacccaggagagcgagugcgugugcaugaacggcagcugcuucaccaucaugaccgacggccccagcaacggcgccgccagcuacaagaucuucaagaucgagaagggcaaggugaccaagaccauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaugggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcgccgccaacuggagcuggcccgacggcgccgagcugcccuucaccaucgacaaguga

SEQ ID NO: 168391 - RNA, 1413 nt, Artificial Sequence
  derived and/or modified sequence opt4 from neuraminidase__InfluenzaA__ABS71648
augaaccccaaccagaagaucaucaccaucggcagcaucagcaucgccaucggcaucaucagccugauccugcagaucggcaacaucaucagcaucugggccagccacagcauccagaccggcaaccagaaccacaccggcaucugcaaccagagaaucaucaccuacgagaacagcaccugggugaacaacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagaccaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcggcaccgccaacuggagcuggcccgacggcgccgagcugcccuucaccaucgacaaguga

SEQ ID NO: 168392 - RNA, 1413 nt, Artificial Sequence
  derived and/or modified sequence opt4 from neuraminidase__InfluenzaA__ABS71649
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacagagccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168393 - RNA, 1413 nt, Artificial Sequence
  derived and/or modified sequence opt4 from neuraminidase__InfluenzaA__ABS71651
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacaacaccugggugaaccacaccuacgugaacaucaacaacaccaacgugguggccggcaaggacaagaccagcgugacccuggccggcaacagcagccugugcagcgugagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccagcuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggcugggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcaacaccgccaacuggagcuggcccgacggcgccgagcugcccuucaccaucgacaaguga

SEQ ID NO: 168394 - RNA, 1413 nt, Artificial Sequence
  derived and/or modified sequence opt4 from neuraminidase__InfluenzaA__ABS71652
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacaacaccugggugaaccacaccuacgugaacaucaacaacaccaacgugguggccggcaaggacaagaccagcgugacccuggccggcaacagcagccugugcagcgugagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccagcuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcaacaccgccaacuggagcuggcccgacggcgccgagcugcccuucaccaucgacaaguga

SEQ ID NO: 168395 - RNA, 1413 nt, Artificial Sequence
  derived and/or modified sequence opt4 from neuraminidase__InfluenzaA__ABS71653
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugaucugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcagagagcugaacgcccccaacuuccacuacgaggagugcagcugcuaccccgacaucggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccgccgacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168396 - RNA, 1410 nt, Artificial Sequence
  derived and/or modified sequence opt4 from neuraminidase__InfluenzaA__ABS71655
augaaccccaucaagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168397 - RNA, 1410 nt, Artificial Sequence
  derived and/or modified sequence opt4 from neuraminidase__InfluenzaA__ABS71657
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacgccuggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168398 - RNA, 1410 nt, Artificial Sequence
  derived and/or modified sequence opt4 from neuraminidase__InfluenzaA__ABS71659
augaaccccaucaagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucggcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccacaugcccaucuga

SEQ ID NO: 168399 - RNA, 1410 nt, Artificial Sequence
  derived and/or modified sequence opt4 from neuraminidase__InfluenzaA__ABS71660
augaaccccaucaagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168400 - RNA, 1410 nt, Artificial Sequence
  derived and/or modified sequence opt4 from neuraminidase__InfluenzaA__ABS71661
auguaccccaucaagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168401 - RNA, 1410 nt, Artificial Sequence
  derived and/or modified sequence opt4 from neuraminidase__InfluenzaA__ABS71662
augaaccccaucaagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168402 - RNA, 1410 nt, Artificial Sequence
  derived and/or modified sequence opt4 from neuraminidase__InfluenzaA__ABS71663
auguaccccaucaagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgaccagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaacagcaagcugcagaugaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168403 - RNA, 1410 nt, Artificial Sequence
  derived and/or modified sequence opt4 from neuraminidase__InfluenzaA__ABU40956
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaacugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucaucgacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168404 - RNA, 1410 nt, Artificial Sequence
  derived and/or modified sequence opt4 from neuraminidase__InfluenzaA__ABU50651
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168405 - RNA, 1410 nt, Artificial Sequence
  derived and/or modified sequence opt4 from neuraminidase__InfluenzaA__ABU80180
augaaccccaaccagaagaucaucaccaucggcagcgugagccugaccaucgccaccaucugcuuccugaugcagaucgccauccuggugaccaccgugacccugcacuucaagcaguacgagugcaacagcuuccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168406 - RNA, 1413 nt, Artificial Sequence; identical to SEQ ID NO: 167348
  derived and/or modified sequence opt4 from neuraminidase__InfluenzaA__ABU80301

SEQ ID NO: 168407 - RNA, 1413 nt, Artificial Sequence
  derived and/or modified sequence opt4 from neuraminidase__InfluenzaA__ABU80312
augaacaccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaugagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168408 - RNA, 1410 nt, Artificial Sequence; identical to SEQ ID NO: 167250
  derived and/or modified sequence opt4 from neuraminidase__InfluenzaA__ABU80323

SEQ ID NO: 168409 - RNA, 1410 nt, Artificial Sequence
  derived and/or modified sequence opt4 from neuraminidase__InfluenzaA__ABU80334
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagacccugagaacccaggagagcgagugcgugugcaucaacggcaccugcaccguggugaugaccgacggcagcgccagcggcaaggccgacaccaagauccuguucaucgaggagggcaagaucauccacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168410 - RNA, 1410 nt, Artificial Sequence; identical to SEQ ID NO: 166674
  derived and/or modified sequence opt4 from neuraminidase__InfluenzaA__ABU92762

SEQ ID NO: 168411 - RNA, 1410 nt, Artificial Sequence
  derived and/or modified sequence opt4 from neuraminidase__InfluenzaA__ABU92764
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucauggagagaaacaucaccgagaucguguaccugaccaacaccaccaucgagaaggagaucugccccaagcuggccgaguacagaaacuggagcaagccccagugcaacgugaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcaagaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168412 - RNA, 1410 nt, Artificial Sequence; identical to SEQ ID NO: 166674
  derived and/or modified sequence opt4 from neuraminidase__InfluenzaA__ABU92765

SEQ ID NO: 168413 - RNA, 1410 nt, Artificial Sequence; identical to SEQ ID NO: 166674
  derived and/or modified sequence opt4 from neuraminidase__InfluenzaA__ABU92766

SEQ ID NO: 168414 - RNA, 1410 nt, Artificial Sequence; identical to SEQ ID NO: 166674
  derived and/or modified sequence opt4 from neuraminidase__InfluenzaA__ABU92767

SEQ ID NO: 168415 - RNA, 1410 nt, Artificial Sequence; identical to SEQ ID NO: 166674
  derived and/or modified sequence opt4 from neuraminidase__InfluenzaA__ABU92768

SEQ ID NO: 168416 - RNA, 1410 nt, Artificial Sequence; identical to SEQ ID NO: 166581
  derived and/or modified sequence opt4 from neuraminidase__InfluenzaA__ABU92769

SEQ ID NO: 168417 - RNA, 1410 nt, Artificial Sequence; identical to SEQ ID NO: 166773
  derived and/or modified sequence opt4 from neuraminidase__InfluenzaA__ABU92770

SEQ ID NO: 168418 - RNA, 1410 nt, Artificial Sequence
  derived and/or modified sequence opt4 from neuraminidase__InfluenzaA__ABU92771
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168419 - RNA, 1410 nt, Artificial Sequence
  derived and/or modified sequence opt4 from neuraminidase__InfluenzaA__ABU92772
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168420 - RNA, 1410 nt, Artificial Sequence
  derived and/or modified sequence opt4 from neuraminidase__InfluenzaA__ABU92773
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaccguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168421 - RNA, 1410 nt, Artificial Sequence
  derived and/or modified sequence opt4 from neuraminidase__InfluenzaA__ABU92774
augaaccccaacagaaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaccguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168422 - RNA, 1410 nt, Artificial Sequence
  derived and/or modified sequence opt4 from neuraminidase__InfluenzaA__ABU92775
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168423 - RNA, 1410 nt, Artificial Sequence; identical to SEQ ID NO: 166847
  derived and/or modified sequence opt4 from neuraminidase__InfluenzaA__ABU92777

SEQ ID NO: 168424 - RNA, 1410 nt, Artificial Sequence
  derived and/or modified sequence opt4 from neuraminidase__InfluenzaA__ABU92778
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggaggugugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168425 - RNA, 1410 nt, Artificial Sequence; identical to SEQ ID NO: 166745
  derived and/or modified sequence opt4 from neuraminidase__InfluenzaA__ABU92779

SEQ ID NO: 168426 - RNA, 1410 nt, Artificial Sequence; identical to SEQ ID NO: 166745
  derived and/or modified sequence opt4 from neuraminidase__InfluenzaA__ABU92780

SEQ ID NO: 168427 - RNA, 1410 nt, Artificial Sequence; identical to SEQ ID NO: 166745
  derived and/or modified sequence opt4 from neuraminidase__InfluenzaA__ABU92781

SEQ ID NO: 168428 - RNA, 1410 nt, Artificial Sequence
  derived and/or modified sequence opt4 from neuraminidase__InfluenzaA__ABU92782
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaagagaggagaccgaggugugguggaccagcaacagcaucgugguguucugcggcaccagcggcaccuacggcaccggcagcuggcccgacggcgccgacaucaaccugaugcccaucuga

SEQ ID NO: 168429 - RNA, 1410 nt, Artificial Sequence; identical to SEQ ID NO: 166745
  derived and/or modified sequence opt4 from neuraminidase__InfluenzaA__ABU92783

SEQ ID NO: 168430 - RNA, 1410 nt, Artificial Sequence; identical to SEQ ID NO: 166745
  derived and/or modified sequence opt4 from neuraminidase__InfluenzaA__ABU92784

SEQ ID NO: 168431 - RNA, 1410 nt, Artificial Sequence; identical to SEQ ID NO: 166745
  derived and/or modified sequence opt4 from neuraminidase__InfluenzaA__ABU92785

SEQ ID NO: 168432 - RNA, 1410 nt, Artificial Sequence; identical to SEQ ID NO: 166745
  derived and/or modified sequence opt4 from neuraminidase__InfluenzaA__ABU92786

SEQ ID NO: 168433 - RNA, 1410 nt, Artificial Sequence
  derived and/or modified sequence opt4 from neuraminidase__InfluenzaA__ABU92787
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagacaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168434 - RNA, 1410 nt, Artificial Sequence
  derived and/or modified sequence opt4 from neuraminidase__InfluenzaA__ABU92789
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcagcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168435 - RNA, 1410 nt, Artificial Sequence; identical to SEQ ID NO: 166847
  derived and/or modified sequence opt4 from neuraminidase__InfluenzaA__ABU92790

SEQ ID NO: 168436 - RNA, 1410 nt, Artificial Sequence
  derived and/or modified sequence opt4 from neuraminidase__InfluenzaA__ABU92791
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaccgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168437 - RNA, 1410 nt, Artificial Sequence
  derived and/or modified sequence opt4 from neuraminidase__InfluenzaA__ABU92792
augaaccccaaccagaagaucaucaccaucggcagcgugagccugaccaucagcaccaucugcuucuucaugcagaucgccauccugaucaccaccgugacccugcacuucaagcaguacguguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaagaacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168438 - RNA, 1410 nt, Artificial Sequence; identical to SEQ ID NO: 167327
  derived and/or modified sequence opt4 from neuraminidase__InfluenzaA__ABU92793

SEQ ID NO: 168439 - RNA, 1410 nt, Artificial Sequence; identical to SEQ ID NO: 168434
  derived and/or modified sequence opt4 from neuraminidase__InfluenzaA__ABU92794

SEQ ID NO: 168440 - RNA, 1410 nt, Artificial Sequence; identical to SEQ ID NO: 166745
  derived and/or modified sequence opt4 from neuraminidase__InfluenzaA__ABU92795

SEQ ID NO: 168441 - RNA, 1410 nt, Artificial Sequence; identical to SEQ ID NO: 166745
  derived and/or modified sequence opt4 from neuraminidase__InfluenzaA__ABU92796

SEQ ID NO: 168442 - RNA, 1410 nt, Artificial Sequence
  derived and/or modified sequence opt4 from neuraminidase__InfluenzaA__ABU92797
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagagaauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucaacgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168443 - RNA, 1410 nt, Artificial Sequence; identical to SEQ ID NO: 166745
  derived and/or modified sequence opt4 from neuraminidase__InfluenzaA__ABU92798

SEQ ID NO: 168444 - RNA, 1410 nt, Artificial Sequence; identical to SEQ ID NO: 166745
  derived and/or modified sequence opt4 from neuraminidase__InfluenzaA__ABU92799

SEQ ID NO: 168445 - RNA, 1410 nt, Artificial Sequence; identical to SEQ ID NO: 166745
  derived and/or modified sequence opt4 from neuraminidase__InfluenzaA__ABU92800

SEQ ID NO: 168446 - RNA, 1410 nt, Artificial Sequence
  derived and/or modified sequence opt4 from neuraminidase__InfluenzaA__ABU92801
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucgugcaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168447 - RNA, 1410 nt, Artificial Sequence; identical to SEQ ID NO: 166745
  derived and/or modified sequence opt4 from neuraminidase__InfluenzaA__ABU92802

SEQ ID NO: 168448 - RNA, 1410 nt, Artificial Sequence; identical to SEQ ID NO: 166745
  derived and/or modified sequence opt4 from neuraminidase__InfluenzaA__ABU92804

SEQ ID NO: 168449 - RNA, 1410 nt, Artificial Sequence
  derived and/or modified sequence opt4 from neuraminidase__InfluenzaA__ABU92805
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168450 - RNA, 1410 nt, Artificial Sequence; identical to SEQ ID NO: 168449
  derived and/or modified sequence opt4 from neuraminidase__InfluenzaA__ABU92806

SEQ ID NO: 168451 - RNA, 1410 nt, Artificial Sequence
  derived and/or modified sequence opt4 from neuraminidase__InfluenzaA__ABU92808
augaaccccaaccagaagaucaucaccaucggcagcgugagccugaccaucgccaccaucugcuuccugaugcagaucaccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168452 - RNA, 1410 nt, Artificial Sequence
  derived and/or modified sequence opt4 from neuraminidase__InfluenzaA__ABU92809
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgacgugcuguggaccagcaacagcaucgugguguucugcggcaccagcggcaccuacggcaccggcagcuggcccgacggcgccgacaucaaccugaugcccaucuga

SEQ ID NO: 168453 - RNA, 1410 nt, Artificial Sequence
  derived and/or modified sequence opt4 from neuraminidase__InfluenzaA__ABU92810
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagggcggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168454 - RNA, 1410 nt, Artificial Sequence
  derived and/or modified sequence opt4 from neuraminidase__InfluenzaA__ABU92811
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaugaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccgugggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168455 - RNA, 1410 nt, Artificial Sequence; identical to SEQ ID NO: 166745
  derived and/or modified sequence opt4 from neuraminidase__InfluenzaA__ABU92814

SEQ ID NO: 168456 - RNA, 1410 nt, Artificial Sequence; identical to SEQ ID NO: 167234
  derived and/or modified sequence opt4 from neuraminidase__InfluenzaA__ABU92815

SEQ ID NO: 168457 - RNA, 1410 nt, Artificial Sequence; identical to SEQ ID NO: 166745
  derived and/or modified sequence opt4 from neuraminidase__InfluenzaA__ABU92816

SEQ ID NO: 168458 - RNA, 1410 nt, Artificial Sequence
  derived and/or modified sequence opt4 from neuraminidase__InfluenzaA__ABU92817
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagagcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168459 - RNA, 1410 nt, Artificial Sequence; identical to SEQ ID NO: 166745
  derived and/or modified sequence opt4 from neuraminidase__InfluenzaA__ABU92818

SEQ ID NO: 168460 - RNA, 1410 nt, Artificial Sequence; identical to SEQ ID NO: 166745
  derived and/or modified sequence opt4 from neuraminidase__InfluenzaA__ABU92819

SEQ ID NO: 168461 - RNA, 1410 nt, Artificial Sequence; identical to SEQ ID NO: 166745
  derived and/or modified sequence opt4 from neuraminidase__InfluenzaA__ABU92821

SEQ ID NO: 168462 - RNA, 1410 nt, Artificial Sequence; identical to SEQ ID NO: 166745
  derived and/or modified sequence opt4 from neuraminidase__InfluenzaA__ABU92822

SEQ ID NO: 168463 - RNA, 1410 nt, Artificial Sequence; identical to SEQ ID NO: 166657
  derived and/or modified sequence opt4 from neuraminidase__InfluenzaA__ABU92823

SEQ ID NO: 168464 - RNA, 1410 nt, Artificial Sequence
  derived and/or modified sequence opt4 from neuraminidase__InfluenzaA__ABU92824
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaagaaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168465 - RNA, 1410 nt, Artificial Sequence
  derived and/or modified sequence opt4 from neuraminidase__InfluenzaA__ABU92825
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168466 - RNA, 1410 nt, Artificial Sequence; identical to SEQ ID NO: 168465
  derived and/or modified sequence opt4 from neuraminidase__InfluenzaA__ABU92826

SEQ ID NO: 168467 - RNA, 1410 nt, Artificial Sequence; identical to SEQ ID NO: 166745
  derived and/or modified sequence opt4 from neuraminidase__InfluenzaA__ABU92827

SEQ ID NO: 168468 - RNA, 1410 nt, Artificial Sequence; identical to SEQ ID NO: 166745
  derived and/or modified sequence opt4 from neuraminidase__InfluenzaA__ABU92828

SEQ ID NO: 168469 - RNA, 1410 nt, Artificial Sequence; identical to SEQ ID NO: 167234
  derived and/or modified sequence opt4 from neuraminidase__InfluenzaA__ABU92829

SEQ ID NO: 168470 - RNA, 1410 nt, Artificial Sequence
  derived and/or modified sequence opt4 from neuraminidase__InfluenzaA__ABU92830
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagcagaugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168471 - RNA, 1410 nt, Artificial Sequence; identical to SEQ ID NO: 166745
  derived and/or modified sequence opt4 from neuraminidase__InfluenzaA__ABU92831

SEQ ID NO: 168472 - RNA, 1410 nt, Artificial Sequence; identical to SEQ ID NO: 166745
  derived and/or modified sequence opt4 from neuraminidase__InfluenzaA__ABU92832

SEQ ID NO: 168473 - RNA, 1410 nt, Artificial Sequence; identical to SEQ ID NO: 166745
  derived and/or modified sequence opt4 from neuraminidase__InfluenzaA__ABU92833

SEQ ID NO: 168474 - RNA, 1410 nt, Artificial Sequence
  derived and/or modified sequence opt4 from neuraminidase__InfluenzaA__ABU92834
augaaccccaaccagaagaucaucaccaucggcagcgugagccugaccaucgccgccaucugcuuccugaugcacaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucagccugaugcccaucuga

SEQ ID NO: 168475 - RNA, 1410 nt, Artificial Sequence; identical to SEQ ID NO: 166745
  derived and/or modified sequence opt4 from neuraminidase__InfluenzaA__ABU92835

SEQ ID NO: 168476 - RNA, 1410 nt, Artificial Sequence; identical to SEQ ID NO: 166745
  derived and/or modified sequence opt4 from neuraminidase__InfluenzaA__ABU92836

SEQ ID NO: 168477 - RNA, 1410 nt, Artificial Sequence
  derived and/or modified sequence opt4 from neuraminidase__InfluenzaA__ABU92837
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgccagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcgugaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168478 - RNA, 1410 nt, Artificial Sequence; identical to SEQ ID NO: 166745
  derived and/or modified sequence opt4 from neuraminidase__InfluenzaA__ABU92838

SEQ ID NO: 168479 - RNA, 1410 nt, Artificial Sequence; identical to SEQ ID NO: 166581
  derived and/or modified sequence opt4 from neuraminidase__InfluenzaA__ABU92839

SEQ ID NO: 168480 - RNA, 1410 nt, Artificial Sequence
  derived and/or modified sequence opt4 from neuraminidase__InfluenzaA__ABU92840
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168481 - RNA, 1410 nt, Artificial Sequence
  derived and/or modified sequence opt4 from neuraminidase__InfluenzaA__ABU92841
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168482 - RNA, 1410 nt, Artificial Sequence
  derived and/or modified sequence opt4 from neuraminidase__InfluenzaA__ABU92842
augaaccccaaccagaagaucaucaccaucggcagcgugagccugaccaucgccaccaucugcuuccugaugcagaucgccauccuggugaccaccgugacccugcacuucaagcaguacgacugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 168483 - RNA, 1410 nt, Artificial Sequence; identical to SEQ ID NO: 166581
  derived and/or modified sequence opt4 from neuraminidase__InfluenzaA__ABU92843

SEQ ID NO: 168484 - RNA, 1410 nt, Artificial Sequence; identical to SEQ ID NO: 168269
  derived and/or modified sequence opt4 from neuraminidase__InfluenzaA__ABU92844

SEQ ID NO: 168485 - RNA, 1410 nt, Artificial Sequence; identical to SEQ ID NO: 166581
  derived and/or modified sequence opt4 from neuraminidase__InfluenzaA__ABU92845

SEQ ID NO: 168486 - RNA, 1410 nt, Artificial Sequence; identical to SEQ ID NO: 166581
  derived and/or modified sequence opt4 from neuraminidase__InfluenzaA__ABU92846

SEQ ID NO: 168487 - RNA, 1410 nt, Artificial Sequence; identical to SEQ ID NO: 166581
  derived and/or modified sequence opt4 from neuraminidase__InfluenzaA__ABU92847

SEQ ID NO: 168488 - RNA, 1410 nt, Artificial Sequence; identical to SEQ ID NO: 166581
  derived and/or modified sequence opt4 from neuraminidase__InfluenzaA__ABU92848

SEQ ID NO: 168489 - RNA, 1410 nt, Artificial Sequence; identical to SEQ ID NO: 167234
  derived and/or modified sequence opt4 from neuraminidase__InfluenzaA__ABU92849

SEQ ID NO: 168490 - RNA, 1410 nt, Artificial Sequence
  derived and/or modified sequence opt4 from neuraminidase__InfluenzaA__ABU92850
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcugguggaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaccgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgacaucaaccugaugcccaucuga

SEQ ID NO: 168491 - RNA, 1410 nt, Artificial Sequence
  derived and/or modified sequence opt4 from neuraminidase__InfluenzaA__ABU92851
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcagcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaaggacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168492 - RNA, 1410 nt, Artificial Sequence; identical to SEQ ID NO: 166745
  derived and/or modified sequence opt4 from neuraminidase__InfluenzaA__ABU92852

SEQ ID NO: 168493 - RNA, 1410 nt, Artificial Sequence
  derived and/or modified sequence opt4 from neuraminidase__InfluenzaA__ABU92853
augaaccccaaccagaagaucaucaccaucggcagcgugagccugaccaucgccgccaucugcuuccugaugcagaucgccauccuggugaccaccgugacccugcacuucaagcagcacgagugcaacagcccccccaagaaccaggugaugcugugcgagcccaccaucaucgagagaaacaucaccgagaucguguacaugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168494 - RNA, 1410 nt, Artificial Sequence; identical to SEQ ID NO: 166745
  derived and/or modified sequence opt4 from neuraminidase__InfluenzaA__ABU92854

SEQ ID NO: 168495 - RNA, 1410 nt, Artificial Sequence
  derived and/or modified sequence opt4 from neuraminidase__InfluenzaA__ABU92855
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucaucgagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168496 - RNA, 1410 nt, Artificial Sequence; identical to SEQ ID NO: 166665
  derived and/or modified sequence opt4 from neuraminidase__InfluenzaA__ABU92856

SEQ ID NO: 168497 - RNA, 1410 nt, Artificial Sequence; identical to SEQ ID NO: 166745
  derived and/or modified sequence opt4 from neuraminidase__InfluenzaA__ABU92857

SEQ ID NO: 168498 - RNA, 1410 nt, Artificial Sequence
  derived and/or modified sequence opt4 from neuraminidase__InfluenzaA__ABU92858
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugauccugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168499 - RNA, 1410 nt, Artificial Sequence
  derived and/or modified sequence opt4 from neuraminidase__InfluenzaA__ABU92859
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccggcuacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168500 - RNA, 1410 nt, Artificial Sequence
  derived and/or modified sequence opt4 from neuraminidase__InfluenzaA__ABU92860
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcugguacaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucaucagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168501 - RNA, 1410 nt, Artificial Sequence
  derived and/or modified sequence opt4 from neuraminidase__InfluenzaA__ABU92861
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcauggccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168502 - RNA, 1410 nt, Artificial Sequence
  derived and/or modified sequence opt4 from neuraminidase__InfluenzaA__ABU92862
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcagagacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168503 - RNA, 1410 nt, Artificial Sequence; identical to SEQ ID NO: 166745
  derived and/or modified sequence opt4 from neuraminidase__InfluenzaA__ABU92863

SEQ ID NO: 168504 - RNA, 1410 nt, Artificial Sequence
  derived and/or modified sequence opt4 from neuraminidase__InfluenzaA__ABU92865
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccuggacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168505 - RNA, 1410 nt, Artificial Sequence
  derived and/or modified sequence opt4 from neuraminidase__InfluenzaA__ABU92866
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggaggugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcaacagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168506 - RNA, 1410 nt, Artificial Sequence; identical to SEQ ID NO: 167327
  derived and/or modified sequence opt4 from neuraminidase__InfluenzaA__ABU92867

SEQ ID NO: 168507 - RNA, 1410 nt, Artificial Sequence; identical to SEQ ID NO: 168434
  derived and/or modified sequence opt4 from neuraminidase__InfluenzaA__ABU92868

SEQ ID NO: 168508 - RNA, 1410 nt, Artificial Sequence; identical to SEQ ID NO: 167214
  derived and/or modified sequence opt4 from neuraminidase__InfluenzaA__ABU92869

SEQ ID NO: 168509 - RNA, 1410 nt, Artificial Sequence; identical to SEQ ID NO: 168404
  derived and/or modified sequence opt4 from neuraminidase__InfluenzaA__ABU92870

SEQ ID NO: 168510 - RNA, 1410 nt, Artificial Sequence
  derived and/or modified sequence opt4 from neuraminidase__InfluenzaA__ABU92872
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacaacaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168511 - RNA, 1410 nt, Artificial Sequence
  derived and/or modified sequence opt4 from neuraminidase__InfluenzaA__ABU92873
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaacaucaugcccaucuga

SEQ ID NO: 168512 - RNA, 1410 nt, Artificial Sequence; identical to SEQ ID NO: 168449
  derived and/or modified sequence opt4 from neuraminidase__InfluenzaA__ABU92874

SEQ ID NO: 168513 - RNA, 1410 nt, Artificial Sequence; identical to SEQ ID NO: 166745
  derived and/or modified sequence opt4 from neuraminidase__InfluenzaA__ABU92875

SEQ ID NO: 168514 - RNA, 1410 nt, Artificial Sequence; identical to SEQ ID NO: 166745
  derived and/or modified sequence opt4 from neuraminidase__InfluenzaA__ABU92876

SEQ ID NO: 168515 - RNA, 1410 nt, Artificial Sequence; identical to SEQ ID NO: 166665
  derived and/or modified sequence opt4 from neuraminidase__InfluenzaA__ABU92877

SEQ ID NO: 168516 - RNA, 1410 nt, Artificial Sequence; identical to SEQ ID NO: 166745
  derived and/or modified sequence opt4 from neuraminidase__InfluenzaA__ABU92878

SEQ ID NO: 168517 - RNA, 1410 nt, Artificial Sequence
  derived and/or modified sequence opt4 from neuraminidase__InfluenzaA__ABU92879
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaagggcgagaccgaggugugguggaccagcaacagcaucgugguguucugcggcaccagcggcaccuacggcaccggcagcuggcccgacggcgccgacaucaaccugaugcccaucuga

SEQ ID NO: 168518 - RNA, 1410 nt, Artificial Sequence; identical to SEQ ID NO: 168510
  derived and/or modified sequence opt4 from neuraminidase__InfluenzaA__ABU92880

SEQ ID NO: 168519 - RNA, 1410 nt, Artificial Sequence; identical to SEQ ID NO: 166745
  derived and/or modified sequence opt4 from neuraminidase__InfluenzaA__ABU92881

SEQ ID NO: 168520 - RNA, 1410 nt, Artificial Sequence; identical to SEQ ID NO: 166745
  derived and/or modified sequence opt4 from neuraminidase__InfluenzaA__ABU92882

SEQ ID NO: 168521 - RNA, 1410 nt, Artificial Sequence
  derived and/or modified sequence opt4 from neuraminidase__InfluenzaA__ABU92883
augaaccccaaccagaagaucaucaccaucggcagcgugagccugaccaucgccgccaucugcuuccugaugcagaucgccauccuggugaccaccgugacccugcacuucaagcagcacgagugcaacagcccccccaagaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168522 - RNA, 1410 nt, Artificial Sequence; identical to SEQ ID NO: 166745
  derived and/or modified sequence opt4 from neuraminidase__InfluenzaA__ABU92884

SEQ ID NO: 168523 - RNA, 1410 nt, Artificial Sequence; identical to SEQ ID NO: 166745
  derived and/or modified sequence opt4 from neuraminidase__InfluenzaA__ABU92885

SEQ ID NO: 168524 - RNA, 1410 nt, Artificial Sequence; identical to SEQ ID NO: 167234
  derived and/or modified sequence opt4 from neuraminidase__InfluenzaA__ABU92886

SEQ ID NO: 168525 - RNA, 1410 nt, Artificial Sequence; identical to SEQ ID NO: 166745
  derived and/or modified sequence opt4 from neuraminidase__InfluenzaA__ABU92887

SEQ ID NO: 168526 - RNA, 1410 nt, Artificial Sequence
  derived and/or modified sequence opt4 from neuraminidase__InfluenzaA__ABU92888
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucaucagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugguggagggcuggagcaaccccaacagcaagcugcagaucaacagacaggugaucguggacagagacaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 168527 - RNA, 1410 nt, Artificial Sequence; identical to SEQ ID NO: 168449
  derived and/or modified sequence opt4 from neuraminidase__InfluenzaA__ABU92889

SEQ ID NO: 168528 - RNA, 1410 nt, Artificial Sequence
  derived and/or modified sequence opt4 from neuraminidase__InfluenzaA__ABU92890
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcuggugagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168529 - RNA, 1410 nt, Artificial Sequence; identical to SEQ ID NO: 168465
  derived and/or modified sequence opt4 from neuraminidase__InfluenzaA__ABU92891

SEQ ID NO: 168530 - RNA, 1410 nt, Artificial Sequence
  derived and/or modified sequence opt4 from neuraminidase__InfluenzaA__ABU92892
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcaacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168531 - RNA, 1410 nt, Artificial Sequence; identical to SEQ ID NO: 167327
  derived and/or modified sequence opt4 from neuraminidase__InfluenzaA__ABU92893

SEQ ID NO: 168532 - RNA, 1410 nt, Artificial Sequence
  derived and/or modified sequence opt4 from neuraminidase__InfluenzaA__ABU92895
augaaccccaaccagaagaucaucaccgugggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgccagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168533 - RNA, 1410 nt, Artificial Sequence
  derived and/or modified sequence opt4 from neuraminidase__InfluenzaA__ABU92896
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcaacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacagaaacgacguguggaugggcagaaccaucagcgagaagagcagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168534 - RNA, 1410 nt, Artificial Sequence
  derived and/or modified sequence opt4 from neuraminidase__InfluenzaA__ABU92897
augaaccccaaccagaagaucaucaccaucggcagcgugagccugaccaucagcaccaucugcuucuucaugcagaucgccauccugaucaccaccgugacccugcacuucaagcaguacgagcugaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168535 - RNA, 1410 nt, Artificial Sequence
  derived and/or modified sequence opt4 from neuraminidase__InfluenzaA__ABU92898
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaagaacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaaccggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168536 - RNA, 1410 nt, Artificial Sequence; identical to SEQ ID NO: 166745
  derived and/or modified sequence opt4 from neuraminidase__InfluenzaA__ABU92899

SEQ ID NO: 168537 - RNA, 1410 nt, Artificial Sequence
  derived and/or modified sequence opt4 from neuraminidase__InfluenzaA__ABU92900
augaaccccaaccagaagaucaucaccaucggcagcgugagccugaccaucgccgccaucugcuuccugaugcagaucgccauccuggugaccaccgugacccugcacuucaagcagcacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168538 - RNA, 1410 nt, Artificial Sequence
  derived and/or modified sequence opt4 from neuraminidase__InfluenzaA__ABU92901
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucagcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168539 - RNA, 1410 nt, Artificial Sequence; identical to SEQ ID NO: 166745
  derived and/or modified sequence opt4 from neuraminidase__InfluenzaA__ABU92902

SEQ ID NO: 168540 - RNA, 1410 nt, Artificial Sequence; identical to SEQ ID NO: 166745
  derived and/or modified sequence opt4 from neuraminidase__InfluenzaA__ABU92903

SEQ ID NO: 168541 - RNA, 1410 nt, Artificial Sequence; identical to SEQ ID NO: 167700
  derived and/or modified sequence opt4 from neuraminidase__InfluenzaA__ABU92904

SEQ ID NO: 168542 - RNA, 1410 nt, Artificial Sequence; identical to SEQ ID NO: 166745
  derived and/or modified sequence opt4 from neuraminidase__InfluenzaA__ABU92905

SEQ ID NO: 168543 - RNA, 1410 nt, Artificial Sequence
  derived and/or modified sequence opt4 from neuraminidase__InfluenzaA__ABU92906
augaaccccaaccagaagaucaucaccaucggcagcgugagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaagcugaugcccaucuga

SEQ ID NO: 168544 - RNA, 1410 nt, Artificial Sequence
  derived and/or modified sequence opt4 from neuraminidase__InfluenzaA__ABU92907
augaaccccaaccagaagaucaucaccaucggcagcaucagccugaccaucgccgccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 168545 - RNA, 1410 nt, Artificial Sequence; identical to SEQ ID NO: 166745
  derived and/or modified sequence opt4 from neuraminidase__InfluenzaA__ABU92908

SEQ ID NO: 168546 - RNA, 1410 nt, Artificial Sequence; identical to SEQ ID NO: 166745
  derived and/or modified sequence opt4 from neuraminidase__InfluenzaA__ABU92909

SEQ ID NO: 168547 - RNA, 1410 nt, Artificial Sequence
  derived and/or modified sequence opt4 from neuraminidase__InfluenzaA__ABU92910
augaaccccaaccagaagaucaucaccaucggcagcgugagccugaccaucgccaccaucugcuuccugacccagaucgccauccugaucaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugagagacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacaagggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 168548 - RNA, 1410 nt, Artificial Sequence
  derived and/or modified sequence opt4 from neuraminidase__InfluenzaA__ABU92911
augaaccccaaccagaagaucaucaccaucggcagcgugagccugaccaucgccaccaucugcuuccugacccagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcaggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucaaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 168549 - RNA, 1410 nt, Artificial Sequence
  derived and/or modified sequence opt4 from neuraminidase__InfluenzaA__ABU92913
augaaccccaaccagaagaucaucaccaucggcagcgugagccugaccaucgccaccaucugcuuccugacccagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucaaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 168550 - RNA, 1413 nt, Artificial Sequence
  derived and/or modified sequence opt4 from neuraminidase__InfluenzaA__ABV29560
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168551 - RNA, 1413 nt, Artificial Sequence; identical to SEQ ID NO: 168550
  derived and/or modified sequence opt4 from neuraminidase__InfluenzaA__ABV29571

SEQ ID NO: 168552 - RNA, 1413 nt, Artificial Sequence; identical to SEQ ID NO: 168550
  derived and/or modified sequence opt4 from neuraminidase__InfluenzaA__ABV29582

SEQ ID NO: 168553 - RNA, 1413 nt, Artificial Sequence; identical to SEQ ID NO: 168550
  derived and/or modified sequence opt4 from neuraminidase__InfluenzaA__ABV29615

SEQ ID NO: 168554 - RNA, 1413 nt, Artificial Sequence
  derived and/or modified sequence opt4 from neuraminidase__InfluenzaA__ABV29637
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcaccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucagcgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168555 - RNA, 1413 nt, Artificial Sequence; identical to SEQ ID NO: 168550
  derived and/or modified sequence opt4 from neuraminidase__InfluenzaA__ABV29648

SEQ ID NO: 168556 - RNA, 1413 nt, Artificial Sequence; identical to SEQ ID NO: 168550
  derived and/or modified sequence opt4 from neuraminidase__InfluenzaA__ABV29659

SEQ ID NO: 168557 - RNA, 1413 nt, Artificial Sequence; identical to SEQ ID NO: 168550
  derived and/or modified sequence opt4 from neuraminidase__InfluenzaA__ABV29670

SEQ ID NO: 168558 - RNA, 1413 nt, Artificial Sequence
  derived and/or modified sequence opt4 from neuraminidase__InfluenzaA__ABV29681
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcaucgacagcgacaccgccaacuggagcuggcccgacggcgccgagcugcccuucaccaucgacaaguga

SEQ ID NO: 168559 - RNA, 1413 nt, Artificial Sequence; identical to SEQ ID NO: 168550
  derived and/or modified sequence opt4 from neuraminidase__InfluenzaA__ABV29692

SEQ ID NO: 168560 - RNA, 1413 nt, Artificial Sequence; identical to SEQ ID NO: 168550
  derived and/or modified sequence opt4 from neuraminidase__InfluenzaA__ABV29703

SEQ ID NO: 168561 - RNA, 1410 nt, Artificial Sequence
  derived and/or modified sequence opt4 from neuraminidase__InfluenzaA__ABV29714
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168562 - RNA, 1410 nt, Artificial Sequence
  derived and/or modified sequence opt4 from neuraminidase__InfluenzaA__ABV29725
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccagggcaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuuccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168563 - RNA, 1413 nt, Artificial Sequence
  derived and/or modified sequence opt4 from neuraminidase__InfluenzaA__ABV29736
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacguggugaccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcgacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacaacgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168564 - RNA, 1413 nt, Artificial Sequence
  derived and/or modified sequence opt4 from neuraminidase__InfluenzaA__ABV29747
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugagacaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168565 - RNA, 1413 nt, Artificial Sequence; identical to SEQ ID NO: 168550
  derived and/or modified sequence opt4 from neuraminidase__InfluenzaA__ABV29769

SEQ ID NO: 168566 - RNA, 1413 nt, Artificial Sequence
  derived and/or modified sequence opt4 from neuraminidase__InfluenzaA__ABV29780
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacguggugaccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcgacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcagcaagcugagaaagggcuucgagaugaucugggaccccaacggcuggaccgacaccgacaacgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168567 - RNA, 1413 nt, Artificial Sequence; identical to SEQ ID NO: 168550
  derived and/or modified sequence opt4 from neuraminidase__InfluenzaA__ABV29791

SEQ ID NO: 168568 - RNA, 1413 nt, Artificial Sequence; identical to SEQ ID NO: 168550
  derived and/or modified sequence opt4 from neuraminidase__InfluenzaA__ABV29802

SEQ ID NO: 168569 - RNA, 1410 nt, Artificial Sequence; identical to SEQ ID NO: 168404
  derived and/or modified sequence opt4 from neuraminidase__InfluenzaA__ABV29824

SEQ ID NO: 168570 - RNA, 1413 nt, Artificial Sequence; identical to SEQ ID NO: 168550
  derived and/or modified sequence opt4 from neuraminidase__InfluenzaA__ABV29835

SEQ ID NO: 168571 - RNA, 1413 nt, Artificial Sequence
  derived and/or modified sequence opt4 from neuraminidase__InfluenzaA__ABV29846
augaaccccaaccagaagaucaucaccaucggcagcaucagcaucgccaucggcaucaucagccugaugcugcagaucggcaacaucaucagcaucugggccagccacagcauccagaucggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168572 - RNA, 1413 nt, Artificial Sequence
  derived and/or modified sequence opt4 from neuraminidase__InfluenzaA__ABV29879
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucaucaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168573 - RNA, 1413 nt, Artificial Sequence; identical to SEQ ID NO: 168550
  derived and/or modified sequence opt4 from neuraminidase__InfluenzaA__ABV29890

SEQ ID NO: 168574 - RNA, 1410 nt, Artificial Sequence; identical to SEQ ID NO: 168404
  derived and/or modified sequence opt4 from neuraminidase__InfluenzaA__ABV29901

SEQ ID NO: 168575 - RNA, 1410 nt, Artificial Sequence
  derived and/or modified sequence opt4 from neuraminidase__InfluenzaA__ABV29912
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggacauccugagaacccaggagagcgagugcaucugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168576 - RNA, 1413 nt, Artificial Sequence
  derived and/or modified sequence opt4 from neuraminidase__InfluenzaA__ABV29923
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacgccaccaucuggaccagcggcagcagcaucagcuucugcggcguggacagcgacaccgccaacuggagcuggcccgacggcgccgagcugcccuucaccaucgacaaguga

SEQ ID NO: 168577 - RNA, 1410 nt, Artificial Sequence
  derived and/or modified sequence opt4 from neuraminidase__InfluenzaA__ABV29934
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaaccggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168578 - RNA, 1413 nt, Artificial Sequence; identical to SEQ ID NO: 168563
  derived and/or modified sequence opt4 from neuraminidase__InfluenzaA__ABV29945

SEQ ID NO: 168579 - RNA, 1413 nt, Artificial Sequence
  derived and/or modified sequence opt4 from neuraminidase__InfluenzaA__ABV29956
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaagggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168580 - RNA, 1413 nt, Artificial Sequence
  derived and/or modified sequence opt4 from neuraminidase__InfluenzaA__ABV29989
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaugagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168581 - RNA, 1413 nt, Artificial Sequence; identical to SEQ ID NO: 168550
  derived and/or modified sequence opt4 from neuraminidase__InfluenzaA__ABV30000

SEQ ID NO: 168582 - RNA, 1413 nt, Artificial Sequence; identical to SEQ ID NO: 168550
  derived and/or modified sequence opt4 from neuraminidase__InfluenzaA__ABV30011

SEQ ID NO: 168583 - RNA, 1413 nt, Artificial Sequence; identical to SEQ ID NO: 168550
  derived and/or modified sequence opt4 from neuraminidase__InfluenzaA__ABV30022

SEQ ID NO: 168584 - RNA, 1413 nt, Artificial Sequence
  derived and/or modified sequence opt4 from neuraminidase__InfluenzaA__ABV30044
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcggcacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168585 - RNA, 1413 nt, Artificial Sequence
  derived and/or modified sequence opt4 from neuraminidase__InfluenzaA__ABV30055
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168586 - RNA, 1410 nt, Artificial Sequence
  derived and/or modified sequence opt4 from neuraminidase__InfluenzaA__ABV30077
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168587 - RNA, 1413 nt, Artificial Sequence; identical to SEQ ID NO: 168550
  derived and/or modified sequence opt4 from neuraminidase__InfluenzaA__ABV30088

SEQ ID NO: 168588 - RNA, 1413 nt, Artificial Sequence; identical to SEQ ID NO: 168550
  derived and/or modified sequence opt4 from neuraminidase__InfluenzaA__ABV30099

SEQ ID NO: 168589 - RNA, 1413 nt, Artificial Sequence
  derived and/or modified sequence opt4 from neuraminidase__InfluenzaA__ABV30110
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168590 - RNA, 1413 nt, Artificial Sequence; identical to SEQ ID NO: 168550
  derived and/or modified sequence opt4 from neuraminidase__InfluenzaA__ABV30132

SEQ ID NO: 168591 - RNA, 1413 nt, Artificial Sequence
  derived and/or modified sequence opt4 from neuraminidase__InfluenzaA__ABV30143
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168592 - RNA, 1413 nt, Artificial Sequence; identical to SEQ ID NO: 168576
  derived and/or modified sequence opt4 from neuraminidase__InfluenzaA__ABV30154

SEQ ID NO: 168593 - RNA, 1413 nt, Artificial Sequence
  derived and/or modified sequence opt4 from neuraminidase__InfluenzaA__ABV30165
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaaccugagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168594 - RNA, 1413 nt, Artificial Sequence; identical to SEQ ID NO: 168550
  derived and/or modified sequence opt4 from neuraminidase__InfluenzaA__ABV30187

SEQ ID NO: 168595 - RNA, 1413 nt, Artificial Sequence; identical to SEQ ID NO: 168550
  derived and/or modified sequence opt4 from neuraminidase__InfluenzaA__ABV30198

SEQ ID NO: 168596 - RNA, 1410 nt, Artificial Sequence; identical to SEQ ID NO: 168404
  derived and/or modified sequence opt4 from neuraminidase__InfluenzaA__ABV30209

SEQ ID NO: 168597 - RNA, 1410 nt, Artificial Sequence; identical to SEQ ID NO: 168586
  derived and/or modified sequence opt4 from neuraminidase__InfluenzaA__ABV30220

SEQ ID NO: 168598 - RNA, 1410 nt, Artificial Sequence; identical to SEQ ID NO: 168586
  derived and/or modified sequence opt4 from neuraminidase__InfluenzaA__ABV30231

SEQ ID NO: 168599 - RNA, 1410 nt, Artificial Sequence
  derived and/or modified sequence opt4 from neuraminidase__InfluenzaA__ABV30264
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgaggugguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168600 - RNA, 1410 nt, Artificial Sequence
  derived and/or modified sequence opt4 from neuraminidase__InfluenzaA__ABV30275
augaaccccaaccagaagaucaucaccaucggcagcgugagccugaccaucagcaccaucugcuucuucaugcagaccgccauccugaucaccaccgugacccugcacuucaagcaguacgaguucaacagcacccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168601 - RNA, 1413 nt, Artificial Sequence; identical to SEQ ID NO: 168591
  derived and/or modified sequence opt4 from neuraminidase__InfluenzaA__ABV30297

SEQ ID NO: 168602 - RNA, 1413 nt, Artificial Sequence
  derived and/or modified sequence opt4 from neuraminidase__InfluenzaA__ABV30308
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugccugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168603 - RNA, 1413 nt, Artificial Sequence
  derived and/or modified sequence opt4 from neuraminidase__InfluenzaA__ABV30319
augaaccccaaccagaagaucaucaccaucggcagcaucagcaucgccaucggcaucaucagccugaugcugcagaucggcaacaucgugagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168604 - RNA, 1413 nt, Artificial Sequence; identical to SEQ ID NO: 168591
  derived and/or modified sequence opt4 from neuraminidase__InfluenzaA__ABV30330

SEQ ID NO: 168605 - RNA, 1413 nt, Artificial Sequence; identical to SEQ ID NO: 168550
  derived and/or modified sequence opt4 from neuraminidase__InfluenzaA__ABV30341

SEQ ID NO: 168606 - RNA, 1413 nt, Artificial Sequence; identical to SEQ ID NO: 168550
  derived and/or modified sequence opt4 from neuraminidase__InfluenzaA__ABV30363

SEQ ID NO: 168607 - RNA, 1413 nt, Artificial Sequence; identical to SEQ ID NO: 168550
  derived and/or modified sequence opt4 from neuraminidase__InfluenzaA__ABV30374

SEQ ID NO: 168608 - RNA, 1410 nt, Artificial Sequence
  derived and/or modified sequence opt4 from neuraminidase__InfluenzaA__ABV30385
augaaccccaaccagaagaucaucaccaucggcagcgugagccugaccaucagcaccaucugcuucuucaugcagaucgccauccugaucaccaccgugacccugcacuucaagcaguacgaguucagccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168609 - RNA, 1410 nt, Artificial Sequence
  derived and/or modified sequence opt4 from neuraminidase__InfluenzaA__ABV30396
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcugagcgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgacaucaaccugaugcccaucuga

SEQ ID NO: 168610 - RNA, 1410 nt, Artificial Sequence
  derived and/or modified sequence opt4 from neuraminidase__InfluenzaA__ABV30407
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168611 - RNA, 1410 nt, Artificial Sequence
  derived and/or modified sequence opt4 from neuraminidase__InfluenzaA__ABV30418
augaaccccaaccagaagaucaucaccaucggcagcgugagccugaccaucagcaccaucugcuucuucaugcagaucgccauccugaucaccaccgugacccugcacuucaagcaguacgaguucagcagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaagagaggagaccgaggugcuguggaccagcaacagcaucgugguguucugcggcaccagcggcaccuacggcaccggcagcuggcccgacggcgccgacaucaaccugaugcccaucuga

SEQ ID NO: 168612 - RNA, 1410 nt, Artificial Sequence; identical to SEQ ID NO: 168577
  derived and/or modified sequence opt4 from neuraminidase__InfluenzaA__ABV30429

SEQ ID NO: 168613 - RNA, 1410 nt, Artificial Sequence; identical to SEQ ID NO: 168577
  derived and/or modified sequence opt4 from neuraminidase__InfluenzaA__ABV30440

SEQ ID NO: 168614 - RNA, 1410 nt, Artificial Sequence; identical to SEQ ID NO: 168577
  derived and/or modified sequence opt4 from neuraminidase__InfluenzaA__ABV30451

SEQ ID NO: 168615 - RNA, 1413 nt, Artificial Sequence; identical to SEQ ID NO: 168550
  derived and/or modified sequence opt4 from neuraminidase__InfluenzaA__ABV30462

SEQ ID NO: 168616 - RNA, 1410 nt, Artificial Sequence; identical to SEQ ID NO: 168577
  derived and/or modified sequence opt4 from neuraminidase__InfluenzaA__ABV30473

SEQ ID NO: 168617 - RNA, 1410 nt, Artificial Sequence
  derived and/or modified sequence opt4 from neuraminidase__InfluenzaA__ABV30484
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcaacagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168618 - RNA, 1413 nt, Artificial Sequence; identical to SEQ ID NO: 168589
  derived and/or modified sequence opt4 from neuraminidase__InfluenzaA__ABV30495

SEQ ID NO: 168619 - RNA, 1413 nt, Artificial Sequence; identical to SEQ ID NO: 168550
  derived and/or modified sequence opt4 from neuraminidase__InfluenzaA__ABV30506

SEQ ID NO: 168620 - RNA, 1410 nt, Artificial Sequence; identical to SEQ ID NO: 168586
  derived and/or modified sequence opt4 from neuraminidase__InfluenzaA__ABV30517

SEQ ID NO: 168621 - RNA, 1413 nt, Artificial Sequence
  derived and/or modified sequence opt4 from neuraminidase__InfluenzaA__ABV30528
augaacagcaaccagaagaucaucaccaucggcagcaucagcaucgccaucggcaucaucagccugaugcugcagaucggcaacaucaucagcaugugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacgccaccaucuggaccagcggcagcagcaucagcuucugcggcguggacagcgacaccgccaacuggagcuggcccgacggcgccgagcugcccuucaccaucgacaaguga

SEQ ID NO: 168622 - RNA, 1413 nt, Artificial Sequence; identical to SEQ ID NO: 168550
  derived and/or modified sequence opt4 from neuraminidase__InfluenzaA__ABV30539

SEQ ID NO: 168623 - RNA, 1413 nt, Artificial Sequence; identical to SEQ ID NO: 168550
  derived and/or modified sequence opt4 from neuraminidase__InfluenzaA__ABV30561

SEQ ID NO: 168624 - RNA, 1413 nt, Artificial Sequence; identical to SEQ ID NO: 168550
  derived and/or modified sequence opt4 from neuraminidase__InfluenzaA__ABV30572

SEQ ID NO: 168625 - RNA, 1413 nt, Artificial Sequence; identical to SEQ ID NO: 168550
  derived and/or modified sequence opt4 from neuraminidase__InfluenzaA__ABV30583

SEQ ID NO: 168626 - RNA, 1413 nt, Artificial Sequence; identical to SEQ ID NO: 168550
  derived and/or modified sequence opt4 from neuraminidase__InfluenzaA__ABV30594

SEQ ID NO: 168627 - RNA, 1413 nt, Artificial Sequence
  derived and/or modified sequence opt4 from neuraminidase__InfluenzaA__ABV30605
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggugggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168628 - RNA, 1413 nt, Artificial Sequence; identical to SEQ ID NO: 168550
  derived and/or modified sequence opt4 from neuraminidase__InfluenzaA__ABV30616

SEQ ID NO: 168629 - RNA, 1413 nt, Artificial Sequence; identical to SEQ ID NO: 168550
  derived and/or modified sequence opt4 from neuraminidase__InfluenzaA__ABV30627

SEQ ID NO: 168630 - RNA, 1410 nt, Artificial Sequence
  derived and/or modified sequence opt4 from neuraminidase__InfluenzaA__ABV30649
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaacgccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168631 - RNA, 1410 nt, Artificial Sequence; identical to SEQ ID NO: 168404
  derived and/or modified sequence opt4 from neuraminidase__InfluenzaA__ABV30660

SEQ ID NO: 168632 - RNA, 1413 nt, Artificial Sequence
  derived and/or modified sequence opt4 from neuraminidase__InfluenzaA__ABV45852
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccaacaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcaacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168633 - RNA, 1410 nt, Artificial Sequence; identical to SEQ ID NO: 168404
  derived and/or modified sequence opt4 from neuraminidase__InfluenzaA__ABV45863

SEQ ID NO: 168634 - RNA, 1413 nt, Artificial Sequence
  derived and/or modified sequence opt4 from neuraminidase__InfluenzaA__ABV45874
augaaccccaaccagaagaucaucaccaucggcagcaucagcaucgccaucggcaucaucagccugaugcugcagaucggcaacaucaucagcaucugggccagcuacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168635 - RNA, 1413 nt, Artificial Sequence; identical to SEQ ID NO: 168550
  derived and/or modified sequence opt4 from neuraminidase__InfluenzaA__ABV45885

SEQ ID NO: 168636 - RNA, 1413 nt, Artificial Sequence; identical to SEQ ID NO: 168563
  derived and/or modified sequence opt4 from neuraminidase__InfluenzaA__ABV45896

SEQ ID NO: 168637 - RNA, 1413 nt, Artificial Sequence; identical to SEQ ID NO: 168550
  derived and/or modified sequence opt4 from neuraminidase__InfluenzaA__ABV45918

SEQ ID NO: 168638 - RNA, 1413 nt, Artificial Sequence
  derived and/or modified sequence opt4 from neuraminidase__InfluenzaA__ABV45929
augaaccccaaccagaagaucaucaccaucggcagcaucagcaucgccaucggcaucaucagccugaugcugcagaucggcaacaucaucagcaugugggccagccacagcauccagaccggcagccagaaccacaccggcaucugcaaccagagaaucaucaccuacgagaacagcaccugggugaaccacaccuacgugaacaucaacaacaccaacguggugaccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcgacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacaacgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacgccaccaucuggaccagcggcagcagcaucagcuucugcggcguggacagcgacaccgccaacuggagcuggcccgacggcgccgagcugcccuucaccaucgacaaguga

SEQ ID NO: 168639 - RNA, 1413 nt, Artificial Sequence
  derived and/or modified sequence opt4 from neuraminidase__InfluenzaA__ABV45940
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucagauacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagagccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168640 - RNA, 1413 nt, Artificial Sequence; identical to SEQ ID NO: 168576
  derived and/or modified sequence opt4 from neuraminidase__InfluenzaA__ABV45951

SEQ ID NO: 168641 - RNA, 1410 nt, Artificial Sequence
  derived and/or modified sequence opt4 from neuraminidase__InfluenzaA__ABV45973
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgacgugcuguggaccagcaacagcaucgugguguucugcggcaccagcggcaccuacggcaccggcagcuggcccgacggcgccgacaucaaccugaugcccaucuga

SEQ ID NO: 168642 - RNA, 1410 nt, Artificial Sequence
  derived and/or modified sequence opt4 from neuraminidase__InfluenzaA__ABV45984
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168643 - RNA, 1410 nt, Artificial Sequence; identical to SEQ ID NO: 168404
  derived and/or modified sequence opt4 from neuraminidase__InfluenzaA__ABV45995

SEQ ID NO: 168644 - RNA, 1413 nt, Artificial Sequence; identical to SEQ ID NO: 168563
  derived and/or modified sequence opt4 from neuraminidase__InfluenzaA__ABV82554

SEQ ID NO: 168645 - RNA, 1410 nt, Artificial Sequence; identical to SEQ ID NO: 168586
  derived and/or modified sequence opt4 from neuraminidase__InfluenzaA__ABV82565

SEQ ID NO: 168646 - RNA, 1410 nt, Artificial Sequence; identical to SEQ ID NO: 168586
  derived and/or modified sequence opt4 from neuraminidase__InfluenzaA__ABW36171

SEQ ID NO: 168647 - RNA, 1413 nt, Artificial Sequence; identical to SEQ ID NO: 168602
  derived and/or modified sequence opt4 from neuraminidase__InfluenzaA__ABW36193

SEQ ID NO: 168648 - RNA, 1413 nt, Artificial Sequence; identical to SEQ ID NO: 168550
  derived and/or modified sequence opt4 from neuraminidase__InfluenzaA__ABW36204

SEQ ID NO: 168649 - RNA, 1413 nt, Artificial Sequence
  derived and/or modified sequence opt4 from neuraminidase__InfluenzaA__ABW36215
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaagggcuggcugaccaucggcaucagcggccccgacaacggcgccguggccgugcugaaguacaacggcaucaucaccgagaccaucaagagcuggaacaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcagaggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagccacuucagcgugaagcaggacgugguggccaucaccgacuggagcggcuacagcggcagcuucgugcagcaccccgagcugaccggccuggacugcaucaagcccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaucaucgacaaguga

SEQ ID NO: 168650 - RNA, 1413 nt, Artificial Sequence; identical to SEQ ID NO: 168550
  derived and/or modified sequence opt4 from neuraminidase__InfluenzaA__ABW36226

SEQ ID NO: 168651 - RNA, 1413 nt, Artificial Sequence
  derived and/or modified sequence opt4 from neuraminidase__InfluenzaA__ABW36237
augaaccccaaccagaagaucaucaccaucggcagcaucagcaucaccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168652 - RNA, 1413 nt, Artificial Sequence; identical to SEQ ID NO: 168550
  derived and/or modified sequence opt4 from neuraminidase__InfluenzaA__ABW36248

SEQ ID NO: 168653 - RNA, 1413 nt, Artificial Sequence
  derived and/or modified sequence opt4 from neuraminidase__InfluenzaA__ABW36259
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacagagccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcgugcugggcgacaaccccagacccgaggacggcgagggcagcugcaaccccgugaccguggacggcgccgacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugagcagcgacaccgccaacuggagcuggcccgacggcgccgagcugcccuucaccaucgacaaguga

SEQ ID NO: 168654 - RNA, 1413 nt, Artificial Sequence; identical to SEQ ID NO: 168550
  derived and/or modified sequence opt4 from neuraminidase__InfluenzaA__ABW36281

SEQ ID NO: 168655 - RNA, 1413 nt, Artificial Sequence; identical to SEQ ID NO: 168550
  derived and/or modified sequence opt4 from neuraminidase__InfluenzaA__ABW36292

SEQ ID NO: 168656 - RNA, 1413 nt, Artificial Sequence; identical to SEQ ID NO: 168563
  derived and/or modified sequence opt4 from neuraminidase__InfluenzaA__ABW36303

SEQ ID NO: 168657 - RNA, 1413 nt, Artificial Sequence
  derived and/or modified sequence opt4 from neuraminidase__InfluenzaA__ABW36314
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucagcaacaccaacgugguggccggcaaggacaccaccagcaugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagcagauccugagaacccaggagagcgagugcgugugcgugaacggcagcugcuucaccaucaugaccgacggccccagcgacggccaggccagcuacagaaucuucaagaucgagaagggcaagaucaccaagagcaucgagcuggacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 168658 - RNA, 1410 nt, Artificial Sequence
  derived and/or modified sequence opt4 from neuraminidase__InfluenzaA__ABW38366
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgccagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168659 - RNA, 1413 nt, Artificial Sequence; identical to SEQ ID NO: 168649
  derived and/or modified sequence opt4 from neuraminidase__InfluenzaA__ABW39780

SEQ ID NO: 168660 - RNA, 1413 nt, Artificial Sequence
  derived and/or modified sequence opt4 from neuraminidase__InfluenzaA__ABW39809
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagacccuggugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168661 - RNA, 1413 nt, Artificial Sequence; identical to SEQ ID NO: 168563
  derived and/or modified sequence opt4 from neuraminidase__InfluenzaA__ABW39820

SEQ ID NO: 168662 - RNA, 1413 nt, Artificial Sequence
  derived and/or modified sequence opt4 from neuraminidase__InfluenzaA__ABW39831
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccuggugggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacggcgacaucgccaacuggagcuggcccgacggcgccgagcugcccuucaccaucgacaaguga

SEQ ID NO: 168663 - RNA, 1413 nt, Artificial Sequence; identical to SEQ ID NO: 168576
  derived and/or modified sequence opt4 from neuraminidase__InfluenzaA__ABW39842

SEQ ID NO: 168664 - RNA, 1413 nt, Artificial Sequence; identical to SEQ ID NO: 168550
  derived and/or modified sequence opt4 from neuraminidase__InfluenzaA__ABW39864

SEQ ID NO: 168665 - RNA, 1410 nt, Artificial Sequence; identical to SEQ ID NO: 168586
  derived and/or modified sequence opt4 from neuraminidase__InfluenzaA__ABW39875

SEQ ID NO: 168666 - RNA, 1413 nt, Artificial Sequence
  derived and/or modified sequence opt4 from neuraminidase__InfluenzaA__ABW39886
augaaccccaaccagaagaucaucaccaucggcagcaucagcaucgccaucggcaucaucagccugauccugcagaucggcaacaucaucagcaucugggccagccacagcauccagaccagaaaccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168667 - RNA, 1413 nt, Artificial Sequence; identical to SEQ ID NO: 168550
  derived and/or modified sequence opt4 from neuraminidase__InfluenzaA__ABW39897

SEQ ID NO: 168668 - RNA, 1413 nt, Artificial Sequence
  derived and/or modified sequence opt4 from neuraminidase__InfluenzaA__ABW39908
augaaccccaaccagaagaucaucaccaucggcagcaucagcaucgccaucggcaucaccagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168669 - RNA, 1413 nt, Artificial Sequence
  derived and/or modified sequence opt4 from neuraminidase__InfluenzaA__ABW39930
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcgacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168670 - RNA, 1413 nt, Artificial Sequence
  derived and/or modified sequence opt4 from neuraminidase__InfluenzaA__ABW39952
augaaccccaaccagaagaucaucaccaucggcagcaucagcaucaccaucggcaucaucagccugaugcugcagaucggcaacaucaucagcaucugggccagccacagcauccagaccggcagccagaaccacaccggcaugugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168671 - RNA, 1413 nt, Artificial Sequence; identical to SEQ ID NO: 168550
  derived and/or modified sequence opt4 from neuraminidase__InfluenzaA__ABW39963

SEQ ID NO: 168672 - RNA, 1413 nt, Artificial Sequence; identical to SEQ ID NO: 168550
  derived and/or modified sequence opt4 from neuraminidase__InfluenzaA__ABW39985

SEQ ID NO: 168673 - RNA, 1413 nt, Artificial Sequence
  derived and/or modified sequence opt4 from neuraminidase__InfluenzaA__ABW39996
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcaccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168674 - RNA, 1413 nt, Artificial Sequence; identical to SEQ ID NO: 168550
  derived and/or modified sequence opt4 from neuraminidase__InfluenzaA__ABW40007

SEQ ID NO: 168675 - RNA, 1413 nt, Artificial Sequence
  derived and/or modified sequence opt4 from neuraminidase__InfluenzaA__ABW40018
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcaucaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacggcgacaccgccaacuggagcuggcccgacggcgccgagcugcccuucaccaucgacaaguga

SEQ ID NO: 168676 - RNA, 1410 nt, Artificial Sequence; identical to SEQ ID NO: 168404
  derived and/or modified sequence opt4 from neuraminidase__InfluenzaA__ABW40029

SEQ ID NO: 168677 - RNA, 1413 nt, Artificial Sequence
  derived and/or modified sequence opt4 from neuraminidase__InfluenzaA__ABW40040
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcaucuggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168678 - RNA, 1413 nt, Artificial Sequence; identical to SEQ ID NO: 168550
  derived and/or modified sequence opt4 from neuraminidase__InfluenzaA__ABW40051

SEQ ID NO: 168679 - RNA, 1413 nt, Artificial Sequence; identical to SEQ ID NO: 168550
  derived and/or modified sequence opt4 from neuraminidase__InfluenzaA__ABW40062

SEQ ID NO: 168680 - RNA, 1410 nt, Artificial Sequence; identical to SEQ ID NO: 168586
  derived and/or modified sequence opt4 from neuraminidase__InfluenzaA__ABW40084

SEQ ID NO: 168681 - RNA, 1413 nt, Artificial Sequence
  derived and/or modified sequence opt4 from neuraminidase__InfluenzaA__ABW40095
augaaccccaaccagaagaucaucaccaucggcagcaucagcguggccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168682 - RNA, 1413 nt, Artificial Sequence
  derived and/or modified sequence opt4 from neuraminidase__InfluenzaA__ABW40106
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugccugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagauggugugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168683 - RNA, 1413 nt, Artificial Sequence; identical to SEQ ID NO: 168550
  derived and/or modified sequence opt4 from neuraminidase__InfluenzaA__ABW40117

SEQ ID NO: 168684 - RNA, 1413 nt, Artificial Sequence; identical to SEQ ID NO: 168550
  derived and/or modified sequence opt4 from neuraminidase__InfluenzaA__ABW40128

SEQ ID NO: 168685 - RNA, 1410 nt, Artificial Sequence; identical to SEQ ID NO: 168404
  derived and/or modified sequence opt4 from neuraminidase__InfluenzaA__ABW40139

SEQ ID NO: 168686 - RNA, 1413 nt, Artificial Sequence; identical to SEQ ID NO: 168550
  derived and/or modified sequence opt4 from neuraminidase__InfluenzaA__ABW40150

SEQ ID NO: 168687 - RNA, 1413 nt, Artificial Sequence; identical to SEQ ID NO: 168550
  derived and/or modified sequence opt4 from neuraminidase__InfluenzaA__ABW40161

SEQ ID NO: 168688 - RNA, 1410 nt, Artificial Sequence
  derived and/or modified sequence opt4 from neuraminidase__InfluenzaA__ABW40172
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaccagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168689 - RNA, 1413 nt, Artificial Sequence; identical to SEQ ID NO: 168550
  derived and/or modified sequence opt4 from neuraminidase__InfluenzaA__ABW40183

SEQ ID NO: 168690 - RNA, 1410 nt, Artificial Sequence; identical to SEQ ID NO: 168404
  derived and/or modified sequence opt4 from neuraminidase__InfluenzaA__ABW40194

SEQ ID NO: 168691 - RNA, 1413 nt, Artificial Sequence; identical to SEQ ID NO: 168585
  derived and/or modified sequence opt4 from neuraminidase__InfluenzaA__ABW40205

SEQ ID NO: 168692 - RNA, 1413 nt, Artificial Sequence; identical to SEQ ID NO: 168589
  derived and/or modified sequence opt4 from neuraminidase__InfluenzaA__ABW40216

SEQ ID NO: 168693 - RNA, 1413 nt, Artificial Sequence; identical to SEQ ID NO: 168589
  derived and/or modified sequence opt4 from neuraminidase__InfluenzaA__ABW40227

SEQ ID NO: 168694 - RNA, 1413 nt, Artificial Sequence; identical to SEQ ID NO: 168550
  derived and/or modified sequence opt4 from neuraminidase__InfluenzaA__ABW40238

SEQ ID NO: 168695 - RNA, 1410 nt, Artificial Sequence
  derived and/or modified sequence opt4 from neuraminidase__InfluenzaA__ABW40249
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168696 - RNA, 1413 nt, Artificial Sequence; identical to SEQ ID NO: 168550
  derived and/or modified sequence opt4 from neuraminidase__InfluenzaA__ABW40260

SEQ ID NO: 168697 - RNA, 1410 nt, Artificial Sequence
  derived and/or modified sequence opt4 from neuraminidase__InfluenzaA__ABW40271
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgagcacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168698 - RNA, 1413 nt, Artificial Sequence; identical to SEQ ID NO: 168550
  derived and/or modified sequence opt4 from neuraminidase__InfluenzaA__ABW40282

SEQ ID NO: 168699 - RNA, 1413 nt, Artificial Sequence; identical to SEQ ID NO: 168585
  derived and/or modified sequence opt4 from neuraminidase__InfluenzaA__ABW40293

SEQ ID NO: 168700 - RNA, 1413 nt, Artificial Sequence; identical to SEQ ID NO: 168550
  derived and/or modified sequence opt4 from neuraminidase__InfluenzaA__ABW40304

SEQ ID NO: 168701 - RNA, 1413 nt, Artificial Sequence; identical to SEQ ID NO: 168550
  derived and/or modified sequence opt4 from neuraminidase__InfluenzaA__ABW40315

SEQ ID NO: 168702 - RNA, 1410 nt, Artificial Sequence; identical to SEQ ID NO: 168404
  derived and/or modified sequence opt4 from neuraminidase__InfluenzaA__ABW40326

SEQ ID NO: 168703 - RNA, 1413 nt, Artificial Sequence; identical to SEQ ID NO: 168591
  derived and/or modified sequence opt4 from neuraminidase__InfluenzaA__ABW40337

SEQ ID NO: 168704 - RNA, 1413 nt, Artificial Sequence; identical to SEQ ID NO: 168585
  derived and/or modified sequence opt4 from neuraminidase__InfluenzaA__ABW40359

SEQ ID NO: 168705 - RNA, 1413 nt, Artificial Sequence
  derived and/or modified sequence opt4 from neuraminidase__InfluenzaA__ABW40370
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacagcggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168706 - RNA, 1413 nt, Artificial Sequence; identical to SEQ ID NO: 168550
  derived and/or modified sequence opt4 from neuraminidase__InfluenzaA__ABW40403

SEQ ID NO: 168707 - RNA, 1413 nt, Artificial Sequence
  derived and/or modified sequence opt4 from neuraminidase__InfluenzaA__ABW40414
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucgaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168708 - RNA, 1413 nt, Artificial Sequence; identical to SEQ ID NO: 168550
  derived and/or modified sequence opt4 from neuraminidase__InfluenzaA__ABW40425

SEQ ID NO: 168709 - RNA, 1413 nt, Artificial Sequence; identical to SEQ ID NO: 168591
  derived and/or modified sequence opt4 from neuraminidase__InfluenzaA__ABW40436

SEQ ID NO: 168710 - RNA, 1413 nt, Artificial Sequence
  derived and/or modified sequence opt4 from neuraminidase__InfluenzaA__ABW40447
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccugaacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168711 - RNA, 1413 nt, Artificial Sequence; identical to SEQ ID NO: 168576
  derived and/or modified sequence opt4 from neuraminidase__InfluenzaA__ABW40458

SEQ ID NO: 168712 - RNA, 1413 nt, Artificial Sequence; identical to SEQ ID NO: 168550
  derived and/or modified sequence opt4 from neuraminidase__InfluenzaA__ABW40469

SEQ ID NO: 168713 - RNA, 1413 nt, Artificial Sequence; identical to SEQ ID NO: 168550
  derived and/or modified sequence opt4 from neuraminidase__InfluenzaA__ABW40491

SEQ ID NO: 168714 - RNA, 1413 nt, Artificial Sequence; identical to SEQ ID NO: 168550
  derived and/or modified sequence opt4 from neuraminidase__InfluenzaA__ABW40502

SEQ ID NO: 168715 - RNA, 1413 nt, Artificial Sequence; identical to SEQ ID NO: 168591
  derived and/or modified sequence opt4 from neuraminidase__InfluenzaA__ABW40513

SEQ ID NO: 168716 - RNA, 1413 nt, Artificial Sequence; identical to SEQ ID NO: 168550
  derived and/or modified sequence opt4 from neuraminidase__InfluenzaA__ABW40524

SEQ ID NO: 168717 - RNA, 1413 nt, Artificial Sequence
  derived and/or modified sequence opt4 from neuraminidase__InfluenzaA__ABW40546
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168718 - RNA, 1413 nt, Artificial Sequence; identical to SEQ ID NO: 168550
  derived and/or modified sequence opt4 from neuraminidase__InfluenzaA__ABW40557

SEQ ID NO: 168719 - RNA, 1413 nt, Artificial Sequence
  derived and/or modified sequence opt4 from neuraminidase__InfluenzaA__ABW40568
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168720 - RNA, 1413 nt, Artificial Sequence
  derived and/or modified sequence opt4 from neuraminidase__InfluenzaA__ABW40579
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccaacaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168721 - RNA, 1413 nt, Artificial Sequence
  derived and/or modified sequence opt4 from neuraminidase__InfluenzaA__ABW40601
augaaccccaaccagaagaucaucaccaucggcagcaucagcaucgccaucggcgugaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcaucaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacggcgacaccgccaacuggagcuggcccgacggcgccgagcugcccuucaccaucgacaaguga

SEQ ID NO: 168722 - RNA, 1413 nt, Artificial Sequence; identical to SEQ ID NO: 168585
  derived and/or modified sequence opt4 from neuraminidase__InfluenzaA__ABW40612

SEQ ID NO: 168723 - RNA, 1413 nt, Artificial Sequence; identical to SEQ ID NO: 168550
  derived and/or modified sequence opt4 from neuraminidase__InfluenzaA__ABW40623

SEQ ID NO: 168724 - RNA, 1410 nt, Artificial Sequence; identical to SEQ ID NO: 168404
  derived and/or modified sequence opt4 from neuraminidase__InfluenzaA__ABW40634

SEQ ID NO: 168725 - RNA, 1413 nt, Artificial Sequence; identical to SEQ ID NO: 168550
  derived and/or modified sequence opt4 from neuraminidase__InfluenzaA__ABW40645

SEQ ID NO: 168726 - RNA, 1410 nt, Artificial Sequence
  derived and/or modified sequence opt4 from neuraminidase__InfluenzaA__ABW40656
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcggcaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168727 - RNA, 1413 nt, Artificial Sequence; identical to SEQ ID NO: 168591
  derived and/or modified sequence opt4 from neuraminidase__InfluenzaA__ABW40667

SEQ ID NO: 168728 - RNA, 1413 nt, Artificial Sequence; identical to SEQ ID NO: 168576
  derived and/or modified sequence opt4 from neuraminidase__InfluenzaA__ABW40678

SEQ ID NO: 168729 - RNA, 1413 nt, Artificial Sequence; identical to SEQ ID NO: 168585
  derived and/or modified sequence opt4 from neuraminidase__InfluenzaA__ABW71297

SEQ ID NO: 168730 - RNA, 1413 nt, Artificial Sequence; identical to SEQ ID NO: 168591
  derived and/or modified sequence opt4 from neuraminidase__InfluenzaA__ABW71308

SEQ ID NO: 168731 - RNA, 1413 nt, Artificial Sequence; identical to SEQ ID NO: 168550
  derived and/or modified sequence opt4 from neuraminidase__InfluenzaA__ABW71319

SEQ ID NO: 168732 - RNA, 1413 nt, Artificial Sequence; identical to SEQ ID NO: 168550
  derived and/or modified sequence opt4 from neuraminidase__InfluenzaA__ABW71330

SEQ ID NO: 168733 - RNA, 1413 nt, Artificial Sequence
  derived and/or modified sequence opt4 from neuraminidase__InfluenzaA__ABW71341
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggcugggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168734 - RNA, 1410 nt, Artificial Sequence; identical to SEQ ID NO: 168577
  derived and/or modified sequence opt4 from neuraminidase__InfluenzaA__ABW71352

SEQ ID NO: 168735 - RNA, 1413 nt, Artificial Sequence; identical to SEQ ID NO: 168591
  derived and/or modified sequence opt4 from neuraminidase__InfluenzaA__ABW71363

SEQ ID NO: 168736 - RNA, 1413 nt, Artificial Sequence; identical to SEQ ID NO: 168576
  derived and/or modified sequence opt4 from neuraminidase__InfluenzaA__ABW71374

SEQ ID NO: 168737 - RNA, 1413 nt, Artificial Sequence; identical to SEQ ID NO: 168550
  derived and/or modified sequence opt4 from neuraminidase__InfluenzaA__ABW71385

SEQ ID NO: 168738 - RNA, 1413 nt, Artificial Sequence
  derived and/or modified sequence opt4 from neuraminidase__InfluenzaA__ABW71396
augaaccccaaccagaagaucaucaccaucggcagcaucagcaucgccaucggcaucaucagccugaugcugcagaucggcaacaucaucagcaucugggccagccacagcgugcagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacgccaccaucuggaccagcggcagcagcaucagcuucugcggcguggacagcgacaccgccaacuggagcuggcccgacggcgccgagcugcccuucaccaucgacaaguga

SEQ ID NO: 168739 - RNA, 1413 nt, Artificial Sequence
  derived and/or modified sequence opt4 from neuraminidase__InfluenzaA__ABW71407
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagaucagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168740 - RNA, 1413 nt, Artificial Sequence; identical to SEQ ID NO: 168576
  derived and/or modified sequence opt4 from neuraminidase__InfluenzaA__ABW71418

SEQ ID NO: 168741 - RNA, 1413 nt, Artificial Sequence; identical to SEQ ID NO: 168550
  derived and/or modified sequence opt4 from neuraminidase__InfluenzaA__ABW71440

SEQ ID NO: 168742 - RNA, 1413 nt, Artificial Sequence; identical to SEQ ID NO: 168550
  derived and/or modified sequence opt4 from neuraminidase__InfluenzaA__ABW71451

SEQ ID NO: 168743 - RNA, 1413 nt, Artificial Sequence; identical to SEQ ID NO: 168585
  derived and/or modified sequence opt4 from neuraminidase__InfluenzaA__ABW71462

SEQ ID NO: 168744 - RNA, 1410 nt, Artificial Sequence; identical to SEQ ID NO: 166847
  derived and/or modified sequence opt4 from neuraminidase__InfluenzaA__ABW80980

SEQ ID NO: 168745 - RNA, 1410 nt, Artificial Sequence; identical to SEQ ID NO: 166691
  derived and/or modified sequence opt4 from neuraminidase__InfluenzaA__ABW80981

SEQ ID NO: 168746 - RNA, 1413 nt, Artificial Sequence
  derived and/or modified sequence opt4 from neuraminidase__InfluenzaA__ABW81474
augaaccccaaccagaagaucaucaccaucggcagcaucagcguggccaucggcaucaucagccugauccugcagaucggcaacaucaucagcaucugggccagccacagcauccagaccggcagccagaacuacaccggcaucugcaaccagaagaucaucaccuacgagaacagaaccugggugaaccagaccuacgugaacuucaacaacaccaacgugguggccggcaaggacaagcccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuucagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 168747 - RNA, 1413 nt, Artificial Sequence
  derived and/or modified sequence opt4 from neuraminidase__InfluenzaA__ABW81475
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagagcagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagccugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168748 - RNA, 1413 nt, Artificial Sequence
  derived and/or modified sequence opt4 from neuraminidase__InfluenzaA__ABW81477
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugagcgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggcccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 168749 - RNA, 1413 nt, Artificial Sequence
  derived and/or modified sequence opt4 from neuraminidase__InfluenzaA__ABW81478
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagaacaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168750 - RNA, 1413 nt, Artificial Sequence
  derived and/or modified sequence opt4 from neuraminidase__InfluenzaA__ABW81479
augaaccccaaccagaagaucaucaccaucggcagcaucagcguggccaucggcaucaucagccugauccugcagaucggcaacaucaucagcaucugggccagccacagcauccagaccggcagccagaacuacaccggcaucugcaaccagaagaucaucaccuacgagaacagaaccugggugaaccagaccuacgugaacaucaacaacaccaacgugguggccggcaaggacaagcccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuucagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcaucaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 168751 - RNA, 1413 nt, Artificial Sequence; identical to SEQ ID NO: 166916
  derived and/or modified sequence opt4 from neuraminidase__InfluenzaA__ABW81480

SEQ ID NO: 168752 - RNA, 1413 nt, Artificial Sequence
  derived and/or modified sequence opt4 from neuraminidase__InfluenzaA__ABW81481
augaaccccaaccagaagaucaucaccaucggcagcaucagcguggccaucggcaucaucagccugauccugcagaucggcaacaucaucagcaucugggccagccacagcauccagaccggcagccagaacuacaccggcaucugcaaccagaagaucaucaccuacgagaacagaaccugggugaaccagaccuacgugaacaucaacaacaccaacgugguggccggcaaggacaagcccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuucagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 168753 - RNA, 1413 nt, Artificial Sequence
  derived and/or modified sequence opt4 from neuraminidase__InfluenzaA__ABW81482
augaaccccaaccagaagaucaucaccaucggcagcaucagcguggccaucggcaucaucagccugauccugcagaucggcaacaucaucagcaucugggccagccacagcauccagaccggcagccagaacuacaccggcaucugcaaccagaagaucaucaccuacgagaacagaaccugggugaaccagaccuacgugaacaucaacaacaccaacgugguggccggcaaggacaagcccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuucagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggccugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 168754 - RNA, 1413 nt, Artificial Sequence; identical to SEQ ID NO: 166906
  derived and/or modified sequence opt4 from neuraminidase__InfluenzaA__ABW81483

SEQ ID NO: 168755 - RNA, 1413 nt, Artificial Sequence
  derived and/or modified sequence opt4 from neuraminidase__InfluenzaA__ABW81484
augaaccccaaccagaagaucaucaccaucggcagcaucagcaucgccaucggcaucaucagccugaugcugcagaucggcaacaucaucagcaucugggccagccacagcauccagaccggcaaccagaaccacaccggcaucugcaaccagagaaucaucaccuacgagaacagcaccugggugaaccacaccuacgugaacaucaacaacaccaacgugguggccggcaagggcaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168756 - RNA, 1413 nt, Artificial Sequence
  derived and/or modified sequence opt4 from neuraminidase__InfluenzaA__ABW81487
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucauccagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168757 - RNA, 1413 nt, Artificial Sequence; identical to SEQ ID NO: 166906
  derived and/or modified sequence opt4 from neuraminidase__InfluenzaA__ABW81488

SEQ ID NO: 168758 - RNA, 1413 nt, Artificial Sequence; identical to SEQ ID NO: 166906
  derived and/or modified sequence opt4 from neuraminidase__InfluenzaA__ABW81489

SEQ ID NO: 168759 - RNA, 1413 nt, Artificial Sequence
  derived and/or modified sequence opt4 from neuraminidase__InfluenzaA__ABW81490
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168760 - RNA, 1413 nt, Artificial Sequence
  derived and/or modified sequence opt4 from neuraminidase__InfluenzaA__ABW81491
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcugggagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168761 - RNA, 1413 nt, Artificial Sequence
  derived and/or modified sequence opt4 from neuraminidase__InfluenzaA__ABW81492
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucugggccagcggcagcagcaucagcuucugcggcguggacagcgacaccgccaacuggagcuggcccgacggcgccgagcugcccuucaccaucgacaaguga

SEQ ID NO: 168762 - RNA, 1413 nt, Artificial Sequence; identical to SEQ ID NO: 166906
  derived and/or modified sequence opt4 from neuraminidase__InfluenzaA__ABW81493

SEQ ID NO: 168763 - RNA, 1413 nt, Artificial Sequence; identical to SEQ ID NO: 166906
  derived and/or modified sequence opt4 from neuraminidase__InfluenzaA__ABW81494

SEQ ID NO: 168764 - RNA, 1413 nt, Artificial Sequence; identical to SEQ ID NO: 166906
  derived and/or modified sequence opt4 from neuraminidase__InfluenzaA__ABW81495

SEQ ID NO: 168765 - RNA, 1413 nt, Artificial Sequence; identical to SEQ ID NO: 168760
  derived and/or modified sequence opt4 from neuraminidase__InfluenzaA__ABW81497

SEQ ID NO: 168766 - RNA, 1413 nt, Artificial Sequence
  derived and/or modified sequence opt4 from neuraminidase__InfluenzaA__ABW81498
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcugggagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168767 - RNA, 1413 nt, Artificial Sequence
  derived and/or modified sequence opt4 from neuraminidase__InfluenzaA__ABW81499
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcagagacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168768 - RNA, 1413 nt, Artificial Sequence
  derived and/or modified sequence opt4 from neuraminidase__InfluenzaA__ABW81500
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccgccgacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168769 - RNA, 1413 nt, Artificial Sequence
  derived and/or modified sequence opt4 from neuraminidase__InfluenzaA__ABW81501
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagaagaucaucaccuacgagaacagcaccugggugaaccacaccuacgugaacaucaacaacaccaacgugguggccggcaaggacaagaccagcgugacccuggccggcaacagcagccugugcagcgugagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168770 - RNA, 1413 nt, Artificial Sequence; identical to SEQ ID NO: 168591
  derived and/or modified sequence opt4 from neuraminidase__InfluenzaA__ABW86324

SEQ ID NO: 168771 - RNA, 1413 nt, Artificial Sequence; identical to SEQ ID NO: 168563
  derived and/or modified sequence opt4 from neuraminidase__InfluenzaA__ABW86335

SEQ ID NO: 168772 - RNA, 1413 nt, Artificial Sequence; identical to SEQ ID NO: 168550
  derived and/or modified sequence opt4 from neuraminidase__InfluenzaA__ABW86346

SEQ ID NO: 168773 - RNA, 1413 nt, Artificial Sequence; identical to SEQ ID NO: 168550
  derived and/or modified sequence opt4 from neuraminidase__InfluenzaA__ABW86357

SEQ ID NO: 168774 - RNA, 1413 nt, Artificial Sequence; identical to SEQ ID NO: 168550
  derived and/or modified sequence opt4 from neuraminidase__InfluenzaA__ABW86368

SEQ ID NO: 168775 - RNA, 1413 nt, Artificial Sequence; identical to SEQ ID NO: 168576
  derived and/or modified sequence opt4 from neuraminidase__InfluenzaA__ABW86379

SEQ ID NO: 168776 - RNA, 1413 nt, Artificial Sequence; identical to SEQ ID NO: 168550
  derived and/or modified sequence opt4 from neuraminidase__InfluenzaA__ABW86390

SEQ ID NO: 168777 - RNA, 1413 nt, Artificial Sequence; identical to SEQ ID NO: 168591
  derived and/or modified sequence opt4 from neuraminidase__InfluenzaA__ABW86401

SEQ ID NO: 168778 - RNA, 1413 nt, Artificial Sequence; identical to SEQ ID NO: 168550
  derived and/or modified sequence opt4 from neuraminidase__InfluenzaA__ABW86412

SEQ ID NO: 168779 - RNA, 1413 nt, Artificial Sequence
  derived and/or modified sequence opt4 from neuraminidase__InfluenzaA__ABW86423
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucgccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168780 - RNA, 1413 nt, Artificial Sequence; identical to SEQ ID NO: 168550
  derived and/or modified sequence opt4 from neuraminidase__InfluenzaA__ABW86434

SEQ ID NO: 168781 - RNA, 1413 nt, Artificial Sequence; identical to SEQ ID NO: 168550
  derived and/or modified sequence opt4 from neuraminidase__InfluenzaA__ABW86445

SEQ ID NO: 168782 - RNA, 1413 nt, Artificial Sequence; identical to SEQ ID NO: 168585
  derived and/or modified sequence opt4 from neuraminidase__InfluenzaA__ABW86456

SEQ ID NO: 168783 - RNA, 1413 nt, Artificial Sequence
  derived and/or modified sequence opt4 from neuraminidase__InfluenzaA__ABW86467
augaacaccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcaucaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168784 - RNA, 1413 nt, Artificial Sequence; identical to SEQ ID NO: 168585
  derived and/or modified sequence opt4 from neuraminidase__InfluenzaA__ABW86478

SEQ ID NO: 168785 - RNA, 1413 nt, Artificial Sequence
  derived and/or modified sequence opt4 from neuraminidase__InfluenzaA__ABW86489
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacguggugggcaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168786 - RNA, 1413 nt, Artificial Sequence
  derived and/or modified sequence opt4 from neuraminidase__InfluenzaA__ABW86500
augaaccccaaccagaagaucaugaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcaugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168787 - RNA, 1413 nt, Artificial Sequence; identical to SEQ ID NO: 168550
  derived and/or modified sequence opt4 from neuraminidase__InfluenzaA__ABW86511

SEQ ID NO: 168788 - RNA, 1413 nt, Artificial Sequence
  derived and/or modified sequence opt4 from neuraminidase__InfluenzaA__ABW86522
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccgugaccgacuggagcggcuacagcggcagcuucgugcagcaccccgagcugaccggccuggacugcaucagacccugcuucuggguggagcuggugagaggccugcccagagagaacgccaccaucuggaccagcggcagcagcaucagcuucugcggcguggacagcgacaccgccaacuggagcuggcccgacggcgccgagcugcccuucaccaucgacaaguga

SEQ ID NO: 168789 - RNA, 1413 nt, Artificial Sequence; identical to SEQ ID NO: 168550
  derived and/or modified sequence opt4 from neuraminidase__InfluenzaA__ABW86533

SEQ ID NO: 168790 - RNA, 1413 nt, Artificial Sequence; identical to SEQ ID NO: 168585
  derived and/or modified sequence opt4 from neuraminidase__InfluenzaA__ABW86544

SEQ ID NO: 168791 - RNA, 1413 nt, Artificial Sequence; identical to SEQ ID NO: 168550
  derived and/or modified sequence opt4 from neuraminidase__InfluenzaA__ABW86555

SEQ ID NO: 168792 - RNA, 1410 nt, Artificial Sequence
  derived and/or modified sequence opt4 from neuraminidase__InfluenzaA__ABW86566
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccgugaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168793 - RNA, 1413 nt, Artificial Sequence; identical to SEQ ID NO: 168576
  derived and/or modified sequence opt4 from neuraminidase__InfluenzaA__ABW86609

SEQ ID NO: 168794 - RNA, 1413 nt, Artificial Sequence; identical to SEQ ID NO: 167579
  derived and/or modified sequence opt4 from neuraminidase__InfluenzaA__ABW91188

SEQ ID NO: 168795 - RNA, 1410 nt, Artificial Sequence
  derived and/or modified sequence opt4 from neuraminidase__InfluenzaA__ABW91210
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugauccugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168796 - RNA, 1413 nt, Artificial Sequence; identical to SEQ ID NO: 168550
  derived and/or modified sequence opt4 from neuraminidase__InfluenzaA__ABW91221

SEQ ID NO: 168797 - RNA, 1410 nt, Artificial Sequence
  derived and/or modified sequence opt4 from neuraminidase__InfluenzaA__ABW91232
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagagcaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168798 - RNA, 1410 nt, Artificial Sequence; identical to SEQ ID NO: 168586
  derived and/or modified sequence opt4 from neuraminidase__InfluenzaA__ABW91243

SEQ ID NO: 168799 - RNA, 1410 nt, Artificial Sequence; identical to SEQ ID NO: 168404
  derived and/or modified sequence opt4 from neuraminidase__InfluenzaA__ABW91254

SEQ ID NO: 168800 - RNA, 1410 nt, Artificial Sequence; identical to SEQ ID NO: 168404
  derived and/or modified sequence opt4 from neuraminidase__InfluenzaA__ABW91265

SEQ ID NO: 168801 - RNA, 1413 nt, Artificial Sequence; identical to SEQ ID NO: 168550
  derived and/or modified sequence opt4 from neuraminidase__InfluenzaA__ABW91276

SEQ ID NO: 168802 - RNA, 1413 nt, Artificial Sequence
  derived and/or modified sequence opt4 from neuraminidase__InfluenzaA__ABW91287
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacaucuucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagaccaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcaccgccaacuggagcuggcccgacggcgccgagcugcccuucaccaucgacaaguga

SEQ ID NO: 168803 - RNA, 1413 nt, Artificial Sequence; identical to SEQ ID NO: 168550
  derived and/or modified sequence opt4 from neuraminidase__InfluenzaA__ABW91298

SEQ ID NO: 168804 - RNA, 1413 nt, Artificial Sequence
  derived and/or modified sequence opt4 from neuraminidase__InfluenzaA__ABW91309
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcgacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccgccgacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168805 - RNA, 1413 nt, Artificial Sequence; identical to SEQ ID NO: 168550
  derived and/or modified sequence opt4 from neuraminidase__InfluenzaA__ABW91320

SEQ ID NO: 168806 - RNA, 1413 nt, Artificial Sequence; identical to SEQ ID NO: 168550
  derived and/or modified sequence opt4 from neuraminidase__InfluenzaA__ABW91331

SEQ ID NO: 168807 - RNA, 1413 nt, Artificial Sequence; identical to SEQ ID NO: 168550
  derived and/or modified sequence opt4 from neuraminidase__InfluenzaA__ABW91342

SEQ ID NO: 168808 - RNA, 1413 nt, Artificial Sequence; identical to SEQ ID NO: 168550
  derived and/or modified sequence opt4 from neuraminidase__InfluenzaA__ABW91353

SEQ ID NO: 168809 - RNA, 1413 nt, Artificial Sequence
  derived and/or modified sequence opt4 from neuraminidase__InfluenzaA__ABW91364
augaacaccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacguggugaccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcgacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacaacgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168810 - RNA, 1413 nt, Artificial Sequence; identical to SEQ ID NO: 168550
  derived and/or modified sequence opt4 from neuraminidase__InfluenzaA__ABW91375

SEQ ID NO: 168811 - RNA, 1413 nt, Artificial Sequence; identical to SEQ ID NO: 168576
  derived and/or modified sequence opt4 from neuraminidase__InfluenzaA__ABW91386

SEQ ID NO: 168812 - RNA, 1410 nt, Artificial Sequence
  derived and/or modified sequence opt4 from neuraminidase__InfluenzaA__ABW91397
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcaucugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168813 - RNA, 1413 nt, Artificial Sequence; identical to SEQ ID NO: 168721
  derived and/or modified sequence opt4 from neuraminidase__InfluenzaA__ABW91408

SEQ ID NO: 168814 - RNA, 1413 nt, Artificial Sequence
  derived and/or modified sequence opt4 from neuraminidase__InfluenzaA__ABW91419
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168815 - RNA, 1413 nt, Artificial Sequence
  derived and/or modified sequence opt4 from neuraminidase__InfluenzaA__ABW91430
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcagcguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168816 - RNA, 1410 nt, Artificial Sequence; identical to SEQ ID NO: 168404
  derived and/or modified sequence opt4 from neuraminidase__InfluenzaA__ABW91441

SEQ ID NO: 168817 - RNA, 1413 nt, Artificial Sequence; identical to SEQ ID NO: 168591
  derived and/or modified sequence opt4 from neuraminidase__InfluenzaA__ABW91452

SEQ ID NO: 168818 - RNA, 1413 nt, Artificial Sequence; identical to SEQ ID NO: 168591
  derived and/or modified sequence opt4 from neuraminidase__InfluenzaA__ABW91463

SEQ ID NO: 168819 - RNA, 1413 nt, Artificial Sequence; identical to SEQ ID NO: 168550
  derived and/or modified sequence opt4 from neuraminidase__InfluenzaA__ABW91474

SEQ ID NO: 168820 - RNA, 1413 nt, Artificial Sequence; identical to SEQ ID NO: 168591
  derived and/or modified sequence opt4 from neuraminidase__InfluenzaA__ABW91485

SEQ ID NO: 168821 - RNA, 1413 nt, Artificial Sequence; identical to SEQ ID NO: 168550
  derived and/or modified sequence opt4 from neuraminidase__InfluenzaA__ABW91496

SEQ ID NO: 168822 - RNA, 1413 nt, Artificial Sequence; identical to SEQ ID NO: 168576
  derived and/or modified sequence opt4 from neuraminidase__InfluenzaA__ABW91507

SEQ ID NO: 168823 - RNA, 1413 nt, Artificial Sequence; identical to SEQ ID NO: 168591
  derived and/or modified sequence opt4 from neuraminidase__InfluenzaA__ABW91518

SEQ ID NO: 168824 - RNA, 1413 nt, Artificial Sequence
  derived and/or modified sequence opt4 from neuraminidase__InfluenzaA__ABW91529
augaaccccaaccagaagaucaucaccaucggcagcaucagcaucgccaucggcaccaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168825 - RNA, 1413 nt, Artificial Sequence
  derived and/or modified sequence opt4 from neuraminidase__InfluenzaA__ABW91540
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccuggaugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcguggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168826 - RNA, 1410 nt, Artificial Sequence
  derived and/or modified sequence opt4 from neuraminidase__InfluenzaA__ABW91551
augaaccccaaccagaagaucaucaccaucggcagcgugagccugaccaucagcaccaucugcuucuucaugcagaucgccauccugaucaccaccgugacccugcacuucaagcaguacgaguucaacuucccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168827 - RNA, 1413 nt, Artificial Sequence; identical to SEQ ID NO: 168550
  derived and/or modified sequence opt4 from neuraminidase__InfluenzaA__ABW91562

SEQ ID NO: 168828 - RNA, 1413 nt, Artificial Sequence; identical to SEQ ID NO: 168585
  derived and/or modified sequence opt4 from neuraminidase__InfluenzaA__ABW91584

SEQ ID NO: 168829 - RNA, 1413 nt, Artificial Sequence; identical to SEQ ID NO: 168550
  derived and/or modified sequence opt4 from neuraminidase__InfluenzaA__ABW91595

SEQ ID NO: 168830 - RNA, 1413 nt, Artificial Sequence; identical to SEQ ID NO: 168591
  derived and/or modified sequence opt4 from neuraminidase__InfluenzaA__ABW91606

SEQ ID NO: 168831 - RNA, 1413 nt, Artificial Sequence; identical to SEQ ID NO: 168585
  derived and/or modified sequence opt4 from neuraminidase__InfluenzaA__ABW91617

SEQ ID NO: 168832 - RNA, 1413 nt, Artificial Sequence; identical to SEQ ID NO: 168550
  derived and/or modified sequence opt4 from neuraminidase__InfluenzaA__ABW91628

SEQ ID NO: 168833 - RNA, 1413 nt, Artificial Sequence; identical to SEQ ID NO: 168550
  derived and/or modified sequence opt4 from neuraminidase__InfluenzaA__ABW91639

SEQ ID NO: 168834 - RNA, 1410 nt, Artificial Sequence; identical to SEQ ID NO: 168404
  derived and/or modified sequence opt4 from neuraminidase__InfluenzaA__ABW91650

SEQ ID NO: 168835 - RNA, 1350 nt, Artificial Sequence
  derived and/or modified sequence opt4 from neuraminidase__InfluenzaA__ABX10517
augaaccccaacaagaagaucaucaccaucggcagcaucugcauggugaccggcauggugagccugaugcugcagaucggcaaccugaucagcaucugggugagccacagcauccacaccggcaaccagcacaaggccgagcccaucagcaacaccaacuuccugaccgagaaggccguggccagcgugaagcuggccggcaacagcagccugugccccaucaacggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucugggccagcggcagcagcaucagcuucugcggcgugaacagcgacaccgugggcuggagcuggcccgacggcgccgagcugcccuucaccaucgacaaguga

SEQ ID NO: 168836 - RNA, 1410 nt, Artificial Sequence; identical to SEQ ID NO: 168449
  derived and/or modified sequence opt4 from neuraminidase__InfluenzaA__ABX10527

SEQ ID NO: 168837 - RNA, 1413 nt, Artificial Sequence
  derived and/or modified sequence opt4 from neuraminidase__InfluenzaA__ABX58242
augaaccccaaccagaagaucaucaccaucggcagcaucagcaucgccaucggcaucaucagccugaugcugcagaucggcaacaucaucagcaucuggaccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168838 - RNA, 1413 nt, Artificial Sequence; identical to SEQ ID NO: 168649
  derived and/or modified sequence opt4 from neuraminidase__InfluenzaA__ABX58253

SEQ ID NO: 168839 - RNA, 1413 nt, Artificial Sequence; identical to SEQ ID NO: 168550
  derived and/or modified sequence opt4 from neuraminidase__InfluenzaA__ABX58264

SEQ ID NO: 168840 - RNA, 1413 nt, Artificial Sequence; identical to SEQ ID NO: 168550
  derived and/or modified sequence opt4 from neuraminidase__InfluenzaA__ABX58275

SEQ ID NO: 168841 - RNA, 1413 nt, Artificial Sequence; identical to SEQ ID NO: 168550
  derived and/or modified sequence opt4 from neuraminidase__InfluenzaA__ABX58286

SEQ ID NO: 168842 - RNA, 1413 nt, Artificial Sequence
  derived and/or modified sequence opt4 from neuraminidase__InfluenzaA__ABX58297
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagaagaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168843 - RNA, 1413 nt, Artificial Sequence; identical to SEQ ID NO: 168721
  derived and/or modified sequence opt4 from neuraminidase__InfluenzaA__ABX58308

SEQ ID NO: 168844 - RNA, 1413 nt, Artificial Sequence
  derived and/or modified sequence opt4 from neuraminidase__InfluenzaA__ABX58319
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168845 - RNA, 1413 nt, Artificial Sequence; identical to SEQ ID NO: 168721
  derived and/or modified sequence opt4 from neuraminidase__InfluenzaA__ABX58352

SEQ ID NO: 168846 - RNA, 1413 nt, Artificial Sequence; identical to SEQ ID NO: 168550
  derived and/or modified sequence opt4 from neuraminidase__InfluenzaA__ABX58363

SEQ ID NO: 168847 - RNA, 1413 nt, Artificial Sequence; identical to SEQ ID NO: 168550
  derived and/or modified sequence opt4 from neuraminidase__InfluenzaA__ABX58385

SEQ ID NO: 168848 - RNA, 1413 nt, Artificial Sequence; identical to SEQ ID NO: 168550
  derived and/or modified sequence opt4 from neuraminidase__InfluenzaA__ABX58396

SEQ ID NO: 168849 - RNA, 1413 nt, Artificial Sequence
  derived and/or modified sequence opt4 from neuraminidase__InfluenzaA__ABX58407
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugccccaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168850 - RNA, 1413 nt, Artificial Sequence; identical to SEQ ID NO: 168591
  derived and/or modified sequence opt4 from neuraminidase__InfluenzaA__ABX58418

SEQ ID NO: 168851 - RNA, 1413 nt, Artificial Sequence; identical to SEQ ID NO: 168550
  derived and/or modified sequence opt4 from neuraminidase__InfluenzaA__ABX58429

SEQ ID NO: 168852 - RNA, 1413 nt, Artificial Sequence; identical to SEQ ID NO: 168550
  derived and/or modified sequence opt4 from neuraminidase__InfluenzaA__ABX58440

SEQ ID NO: 168853 - RNA, 1413 nt, Artificial Sequence
  derived and/or modified sequence opt4 from neuraminidase__InfluenzaA__ABX58451
augaaccccaaccagaagaucaucaccaucggcagcaucagcaucgccaucggcaccaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168854 - RNA, 1413 nt, Artificial Sequence; identical to SEQ ID NO: 168591
  derived and/or modified sequence opt4 from neuraminidase__InfluenzaA__ABX58462

SEQ ID NO: 168855 - RNA, 1413 nt, Artificial Sequence; identical to SEQ ID NO: 168550
  derived and/or modified sequence opt4 from neuraminidase__InfluenzaA__ABX58473

SEQ ID NO: 168856 - RNA, 1413 nt, Artificial Sequence; identical to SEQ ID NO: 168591
  derived and/or modified sequence opt4 from neuraminidase__InfluenzaA__ABX58484

SEQ ID NO: 168857 - RNA, 1413 nt, Artificial Sequence
  derived and/or modified sequence opt4 from neuraminidase__InfluenzaA__ABX58495
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacagaaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168858 - RNA, 1413 nt, Artificial Sequence; identical to SEQ ID NO: 168585
  derived and/or modified sequence opt4 from neuraminidase__InfluenzaA__ABX58506

SEQ ID NO: 168859 - RNA, 1413 nt, Artificial Sequence; identical to SEQ ID NO: 168591
  derived and/or modified sequence opt4 from neuraminidase__InfluenzaA__ABX58528

SEQ ID NO: 168860 - RNA, 1413 nt, Artificial Sequence; identical to SEQ ID NO: 168591
  derived and/or modified sequence opt4 from neuraminidase__InfluenzaA__ABX58539

SEQ ID NO: 168861 - RNA, 1413 nt, Artificial Sequence
  derived and/or modified sequence opt4 from neuraminidase__InfluenzaA__ABX58550
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccguggacaaguga

SEQ ID NO: 168862 - RNA, 1413 nt, Artificial Sequence; identical to SEQ ID NO: 168550
  derived and/or modified sequence opt4 from neuraminidase__InfluenzaA__ABX58561

SEQ ID NO: 168863 - RNA, 1413 nt, Artificial Sequence
  derived and/or modified sequence opt4 from neuraminidase__InfluenzaA__ABX58572
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168864 - RNA, 1413 nt, Artificial Sequence; identical to SEQ ID NO: 168550
  derived and/or modified sequence opt4 from neuraminidase__InfluenzaA__ABX58583

SEQ ID NO: 168865 - RNA, 1413 nt, Artificial Sequence; identical to SEQ ID NO: 168550
  derived and/or modified sequence opt4 from neuraminidase__InfluenzaA__ABX58594

SEQ ID NO: 168866 - RNA, 1413 nt, Artificial Sequence; identical to SEQ ID NO: 168576
  derived and/or modified sequence opt4 from neuraminidase__InfluenzaA__ABX58605

SEQ ID NO: 168867 - RNA, 1413 nt, Artificial Sequence; identical to SEQ ID NO: 168576
  derived and/or modified sequence opt4 from neuraminidase__InfluenzaA__ABX58616

SEQ ID NO: 168868 - RNA, 1413 nt, Artificial Sequence; identical to SEQ ID NO: 168550
  derived and/or modified sequence opt4 from neuraminidase__InfluenzaA__ABX58627

SEQ ID NO: 168869 - RNA, 1413 nt, Artificial Sequence; identical to SEQ ID NO: 168550
  derived and/or modified sequence opt4 from neuraminidase__InfluenzaA__ABX58638

SEQ ID NO: 168870 - RNA, 1413 nt, Artificial Sequence
  derived and/or modified sequence opt4 from neuraminidase__InfluenzaA__ABX58682
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccaugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168871 - RNA, 1413 nt, Artificial Sequence
  derived and/or modified sequence opt4 from neuraminidase__InfluenzaA__ABX58693
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacagagccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcgugcugggcgacaaccccagacccgaggacggcgagggcagcugcaaccccgugaccguggacggcgccgacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168872 - RNA, 1413 nt, Artificial Sequence; identical to SEQ ID NO: 168721
  derived and/or modified sequence opt4 from neuraminidase__InfluenzaA__ABX58704

SEQ ID NO: 168873 - RNA, 1413 nt, Artificial Sequence; identical to SEQ ID NO: 168649
  derived and/or modified sequence opt4 from neuraminidase__InfluenzaA__ABX58715

SEQ ID NO: 168874 - RNA, 1350 nt, Artificial Sequence
  derived and/or modified sequence opt4 from neuraminidase__InfluenzaA__ABY19420
augaaccccaaccagaaggugaucaccaucggcagcaucugcauggugaucggcaucgugagccugaugcugcagaucggcaacaugaucagcaucugggugagccacagcauccagaccggcaaccagaaccagguggagcccaucaucaacaccaacuuccugaccggcaaggccguggccagcaucacccuggccggcaacagcagccugugccccaucagaggcugggccauccacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaaggugaucaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccacaacggcgccuacggcgugaagggcuucagcuucaaguacggcaacggcguguggaucggcagaaccaagagccccaacagcagaagcggcuucgagaugaucugggaccccaacggcuggagcgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccguguggaccagcggcagcagcaucagcuucugcggcgugaacagcgacaccgugagcuggagcuggcccgacggcgccgagcugcccuucagcaucgacaaguga

SEQ ID NO: 168875 - RNA, 1350 nt, Artificial Sequence
  derived and/or modified sequence opt4 from neuraminidase__InfluenzaA__ABY19421
augaaccccaaccagaagaucaucaccaucggcagcaucugcauggugaucggcaucgugagccugaugcugcagaucggcaacaugaucagcaucugggugagccacagcauccagaccggcaaccagaaccagguggagcccaucaucaacaccaacuuccugaccggcaaggccguggccagcaucacccuggccggcaacagcagccugugccccaucagaggcugggccauccacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaaggugaucaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccacaacggcgccuacggcgugaagggcuucagcuucaaguacggcaacggcguguggaucggcagaaccaagagccccaacagcagaagcggcuucgagaugaucugggaccccaacggcuggagcgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccguguggaccagcggcagcagcaucagcuucugcggcgugaacagcgacaccgugagcuggagcuggcccgacggcgccgagcugcccuucagcaucgacaaguga

SEQ ID NO: 168876 - RNA, 1413 nt, Artificial Sequence
  derived and/or modified sequence opt4 from neuraminidase__InfluenzaA__ABY51020
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaacccccugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168877 - RNA, 1410 nt, Artificial Sequence; identical to SEQ ID NO: 168586
  derived and/or modified sequence opt4 from neuraminidase__InfluenzaA__ABY51031

SEQ ID NO: 168878 - RNA, 1413 nt, Artificial Sequence
  derived and/or modified sequence opt4 from neuraminidase__InfluenzaA__ABY51042
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacagagccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168879 - RNA, 1413 nt, Artificial Sequence
  derived and/or modified sequence opt4 from neuraminidase__InfluenzaA__ABY51053
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacagagccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcaccgacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168880 - RNA, 1413 nt, Artificial Sequence; identical to SEQ ID NO: 168649
  derived and/or modified sequence opt4 from neuraminidase__InfluenzaA__ABY51064

SEQ ID NO: 168881 - RNA, 1413 nt, Artificial Sequence; identical to SEQ ID NO: 168550
  derived and/or modified sequence opt4 from neuraminidase__InfluenzaA__ABY51075

SEQ ID NO: 168882 - RNA, 1413 nt, Artificial Sequence
  derived and/or modified sequence opt4 from neuraminidase__InfluenzaA__ABY51086
augaaccccaaccagaagaucaucaccaucggcagcaucagcaucgccaucggcaucaucagcaucaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcaucaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacggcgacaccgccaacuggagcuggcccgacggcgccgagcugcccuucaccaucgacaaguga

SEQ ID NO: 168883 - RNA, 1413 nt, Artificial Sequence
  derived and/or modified sequence opt4 from neuraminidase__InfluenzaA__ABY51097
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcguggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168884 - RNA, 1413 nt, Artificial Sequence
  derived and/or modified sequence opt4 from neuraminidase__InfluenzaA__ABY51108
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168885 - RNA, 1413 nt, Artificial Sequence; identical to SEQ ID NO: 168550
  derived and/or modified sequence opt4 from neuraminidase__InfluenzaA__ABY51119

SEQ ID NO: 168886 - RNA, 1410 nt, Artificial Sequence; identical to SEQ ID NO: 168404
  derived and/or modified sequence opt4 from neuraminidase__InfluenzaA__ABY51130

SEQ ID NO: 168887 - RNA, 1413 nt, Artificial Sequence; identical to SEQ ID NO: 168591
  derived and/or modified sequence opt4 from neuraminidase__InfluenzaA__ABY51141

SEQ ID NO: 168888 - RNA, 1413 nt, Artificial Sequence
  derived and/or modified sequence opt4 from neuraminidase__InfluenzaA__ABY51152
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 168889 - RNA, 1413 nt, Artificial Sequence
  derived and/or modified sequence opt4 from neuraminidase__InfluenzaA__ABY51163
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugauccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168890 - RNA, 1413 nt, Artificial Sequence
  derived and/or modified sequence opt4 from neuraminidase__InfluenzaA__ABY51174
augaaccccaaccagaagaugaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168891 - RNA, 1413 nt, Artificial Sequence; identical to SEQ ID NO: 168550
  derived and/or modified sequence opt4 from neuraminidase__InfluenzaA__ABY51185

SEQ ID NO: 168892 - RNA, 1413 nt, Artificial Sequence; identical to SEQ ID NO: 168585
  derived and/or modified sequence opt4 from neuraminidase__InfluenzaA__ABY51196

SEQ ID NO: 168893 - RNA, 1410 nt, Artificial Sequence; identical to SEQ ID NO: 168586
  derived and/or modified sequence opt4 from neuraminidase__InfluenzaA__ABY51229

SEQ ID NO: 168894 - RNA, 1413 nt, Artificial Sequence
  derived and/or modified sequence opt4 from neuraminidase__InfluenzaA__ABY51240
augaaccccaaccagaagaucaucaccaucggcagcaucagcaucgccaucggcaucaucagccugaugcugcagaucggcaacaucaucagcgugugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcuggagcaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168895 - RNA, 1413 nt, Artificial Sequence; identical to SEQ ID NO: 168576
  derived and/or modified sequence opt4 from neuraminidase__InfluenzaA__ABY51251

SEQ ID NO: 168896 - RNA, 1413 nt, Artificial Sequence
  derived and/or modified sequence opt4 from neuraminidase__InfluenzaA__ABY51262
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacgccaccaucuggaccagcggcagcagcaucagcuucugcggcguggacagcgacaccgccaacuggagcuggcccgacggcgccgagcugcccuucaccaucgacaaguga

SEQ ID NO: 168897 - RNA, 1410 nt, Artificial Sequence; identical to SEQ ID NO: 168404
  derived and/or modified sequence opt4 from neuraminidase__InfluenzaA__ABY51273

SEQ ID NO: 168898 - RNA, 1350 nt, Artificial Sequence
  derived and/or modified sequence opt4 from neuraminidase__InfluenzaA__ABY76285
augaaccccaaccagaagaucaucaccaucggcagcaucugcauggugaucggcaucgugagccugaugcugcagaucggcaacaugaucagcaucugggugagccacagcauccagaccggcaaccagagacaggccgagcccaucagcaacaccaaguuccugaccgagaaggccguggccagcgugacccuggccggcaacagcagccugugccccaucagcggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 168899 - RNA, 1413 nt, Artificial Sequence
  derived and/or modified sequence opt4 from neuraminidase__InfluenzaA__ABY81352
augaaccccaaccagaagaucaucaccaucggcagcaucugcauggccaucggcaucaucagccugauccugcagaucggcagcaucaucagcaucugggugagccacagcauccagaccggcagccagaaccacaccggcaucugcaaccagagaaucaucaccuacgagaacagcaccugggugaaccagaccuacgugaacaucagcaacaccaacgugguggccggcaaggacaccaccagcaugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagcagauccugagaacccaggagagcgagugcgugugcgugaacggcagcugcuucaccaucaugaccgacggccccagcgacggccaggccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 168900 - RNA, 1413 nt, Artificial Sequence
  derived and/or modified sequence opt4 from neuraminidase__InfluenzaA__ABY81363
augaaccccaaccagaagaucaucaccaucggcagcaucagcaucgccaucggcaucaucagccugaugcugcagaucggcaacaucaucagcaucugggccagccacagcauccagaucggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168901 - RNA, 1410 nt, Artificial Sequence; identical to SEQ ID NO: 168586
  derived and/or modified sequence opt4 from neuraminidase__InfluenzaA__ABY81374

SEQ ID NO: 168902 - RNA, 1413 nt, Artificial Sequence; identical to SEQ ID NO: 168550
  derived and/or modified sequence opt4 from neuraminidase__InfluenzaA__ABY81385

SEQ ID NO: 168903 - RNA, 1413 nt, Artificial Sequence
  derived and/or modified sequence opt4 from neuraminidase__InfluenzaA__ABY81407
augaaccccaaccagaagaucaucaccaucggcagcaucagcaucgccaucggcaccaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuuccuggugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168904 - RNA, 1410 nt, Artificial Sequence; identical to SEQ ID NO: 168586
  derived and/or modified sequence opt4 from neuraminidase__InfluenzaA__ACA24505

SEQ ID NO: 168905 - RNA, 1413 nt, Artificial Sequence; identical to SEQ ID NO: 168550
  derived and/or modified sequence opt4 from neuraminidase__InfluenzaA__ACA24516

SEQ ID NO: 168906 - RNA, 1413 nt, Artificial Sequence; identical to SEQ ID NO: 168550
  derived and/or modified sequence opt4 from neuraminidase__InfluenzaA__ACA24527

SEQ ID NO: 168907 - RNA, 1410 nt, Artificial Sequence
  derived and/or modified sequence opt4 from neuraminidase__InfluenzaA__ACA24692
augaaccccaaccagaagaucaucaccaucggcagcgugagccugaccaucagcaccaucugcuucuucaugcagaucgccauccugaucaccaccgugacccugcacuucaagcaguacgaguucagccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcaaguacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaacgaggagaccgaggugcuguggaccagcaacagcaucgugguguucugcggcaccagcggcaccuacggcaccggcagcuggcccgacggcgccgacaucaaccugaugcccaucuga

SEQ ID NO: 168908 - RNA, 1410 nt, Artificial Sequence
  derived and/or modified sequence opt4 from neuraminidase__InfluenzaA__ACA24703
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaucaccaucgagaaggagaccugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaacgccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168909 - RNA, 1413 nt, Artificial Sequence
  derived and/or modified sequence opt4 from neuraminidase__InfluenzaA__ACA33539
augaaccccuaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuucuacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168910 - RNA, 1413 nt, Artificial Sequence
  derived and/or modified sequence opt4 from neuraminidase__InfluenzaA__ACA33540
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuucuacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168911 - RNA, 1413 nt, Artificial Sequence
  derived and/or modified sequence opt4 from neuraminidase__InfluenzaA__ACA33582
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuucuacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168912 - RNA, 1413 nt, Artificial Sequence
  derived and/or modified sequence opt4 from neuraminidase__InfluenzaA__ACA33622
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuucuacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168913 - RNA, 1413 nt, Artificial Sequence; identical to SEQ ID NO: 168589
  derived and/or modified sequence opt4 from neuraminidase__InfluenzaA__ACA96522

SEQ ID NO: 168914 - RNA, 1362 nt, Artificial Sequence
  derived and/or modified sequence opt4 from neuraminidase__InfluenzaA__ACC55274
augaaccccaaccagaagaucaucaccaucggcagcgugagccugaccaucgccaccgugugcuuccugaugcagaucgccauccuggccaugaccgugacccugcacuucagacagaacgagugcagcaucagcgccaacagccagguggugcccugcgagcccaccaccgagaaggaggugugcagcaaggugguggacuacagaagcuggagcaagccccagugccagaucaccggcuucgcccccuucagcaaggacaacagcaucagacugagcgccggcggcgacaucuggaucaccagagagcccuacgugagcugcgacaccagcaagugcuaccaguucgcccugggccagggcaccacccuggacaacgagcacagcaacggcaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacagaaacgccaccgccagcuucaucuacaacggcaugcugguggacagcaucggcagcuggagccagaacauccugagaacccaggagagcgagugcgugugcaucaacggcagcugcaccguggugaugaccgacggcagcgccagcggcaaggccgacaccagaauccuguucgugaaggagggcaagaucgugcacaucagcccccugagcggcagcgcccagcacaucgaggagugcagcugcuaccccagauaccccaacgugagaugcgugugcagagacaacuggaagggcagcaacagacccgugaucgacaucaacaugaccgacuacagcaucgacagcagcuacgugugcagcggccuggugggcgacacccccagaaacgaggacagcagcagcagcagcaacugcagagaccccaacgaggagagaggcaaccccggcgugaagggcugggccuucgacagcggcgacgacguguggaugggcagaaccaucagcagagacagcagaagcggcuacgagaccuucagagugaucggcggcuggaccaccgccaacagcaagagccagaccaacagacaggugaucguggacaacaacaacuggagcggcuacagcggcaucuucagcguggagcacaagagcugcaucaacagaugcuucuacguggagcugaucagaggcagacccaaggagaccagagugugguggaccagcaacagcaucgugguguucugcggcaccagcggcaccuacggcaccggcagcuggcccgacggcgccaacaucaacuucaugcccaucuga

SEQ ID NO: 168915 - RNA, 1413 nt, Artificial Sequence; identical to SEQ ID NO: 168849
  derived and/or modified sequence opt4 from neuraminidase__InfluenzaA__ACC61967

SEQ ID NO: 168916 - RNA, 1413 nt, Artificial Sequence
  derived and/or modified sequence opt4 from neuraminidase__InfluenzaA__ACD11077
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucagcaacaccaacgugguggccggcaaggugaccaccagcaugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagcagauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacaacagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugccccugaccaucgacaaguga

SEQ ID NO: 168917 - RNA, 1413 nt, Artificial Sequence
  derived and/or modified sequence opt4 from neuraminidase__InfluenzaA__ACD11078
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucagcaacaccaacgugguggccggcaaggacaccaccagcaugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagcagauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugccccugaccaucgacaaguga

SEQ ID NO: 168918 - RNA, 1413 nt, Artificial Sequence
  derived and/or modified sequence opt4 from neuraminidase__InfluenzaA__ACD11079
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucagcaacaccaacgugguggccggcaaggacaccaccagcaugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugaucaaguacaacggcaucaucaccgagaccaucaagagcuggagaaagcagauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugccccugaccaucgacaaguga

SEQ ID NO: 168919 - RNA, 1413 nt, Artificial Sequence; identical to SEQ ID NO: 168550
  derived and/or modified sequence opt4 from neuraminidase__InfluenzaA__ACD56116

SEQ ID NO: 168920 - RNA, 1413 nt, Artificial Sequence; identical to SEQ ID NO: 168550
  derived and/or modified sequence opt4 from neuraminidase__InfluenzaA__ACD56127

SEQ ID NO: 168921 - RNA, 1410 nt, Artificial Sequence; identical to SEQ ID NO: 168404
  derived and/or modified sequence opt4 from neuraminidase__InfluenzaA__ACD56261

SEQ ID NO: 168922 - RNA, 1410 nt, Artificial Sequence
  derived and/or modified sequence opt4 from neuraminidase__InfluenzaA__ACD56272
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 168923 - RNA, 1413 nt, Artificial Sequence
  derived and/or modified sequence opt4 from neuraminidase__InfluenzaA__ACD56283
augaaccccaaccagaagaucaucaccaucggcagcaucagcauggccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 168924 - RNA, 1410 nt, Artificial Sequence
  derived and/or modified sequence opt4 from neuraminidase__InfluenzaA__ACD56305
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcguggccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 168925 - RNA, 1410 nt, Artificial Sequence
  derived and/or modified sequence opt4 from neuraminidase__InfluenzaA__ACD56316
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcguggccuggagcagcagcagcugccacgacggcaaggccuggcugcacgugugcgugaccggcgacgacaagaacgccaccgccagcuucaucuacgacggcagacugauggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagaaaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagaugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 168926 - RNA, 1410 nt, Artificial Sequence
  derived and/or modified sequence opt4 from neuraminidase__InfluenzaA__ACD56327
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccagcaagugccaccaguucgcccugggccagggcaccacccuggagaacaagcacagcaacggcaccaagcacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacggcggcagacugguggacagcaucgugagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggacagcagaagcggcuacgagaccuucaaggugaucggcggcuggagcacccccaacagcaagagccaggugaacagacaggugaucguggacagcaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 168927 - RNA, 1410 nt, Artificial Sequence
  derived and/or modified sequence opt4 from neuraminidase__InfluenzaA__ACD85190
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccaucaucgacaucaacauggaggacuacagcaucgacagcagcuacgugugcagcggccuggugggcgacacccccagaaacgacgacagaagcagcaacagcaacugcagaaaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 168928 - RNA, 1410 nt, Artificial Sequence
  derived and/or modified sequence opt4 from neuraminidase__InfluenzaA__ACD85201
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucagcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagaaaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 168929 - RNA, 1410 nt, Artificial Sequence
  derived and/or modified sequence opt4 from neuraminidase__InfluenzaA__ACD85212
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaaggagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucaacaaggacagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 168930 - RNA, 1410 nt, Artificial Sequence
  derived and/or modified sequence opt4 from neuraminidase__InfluenzaA__ACD85223
augaaccccaaccagaagaucaucaccaucggcagcgugagccugaccaucgccaccgccugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccaucaucgacaucaacauggaggacuacagcaucgacagcagcuacgugugcagcggccuggugggcgacacccccagaaacgacgacagaagcagcaacagcaacugcagaaaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga
